United States Patent 10,221,454 (METHODS AND COMPOSITIONS FOR SCREENING AND TREATING DEVELOPMENTAL DISORDERS) - sequence listing, part 4

SEQ ID NO: 81 - DNA, 2304637 bp, Homo sapiens
cacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacacttgcagccactgcagtagacaaactcgaaacccagcgtttctgttttggaagagacagggttgtgacgctggtgatgtttctggaaagttgttcctggtcttggtgatcggttggcaagagcttggctagagagactgatgtagatggcagcttcttaggagttgtttgtgcagggagagttaactgcatttggcttaggtaggtcagtgaatgaaaagtgaagaccatggcaaaaccaagtttcttatttttatttatggttataacttaatgagcacggggttgaggttaacaagaggagcatgttttaaacagtttgggcacctatagggtctctttaacctctcccgttcccttaaaaagttaatgcccatttagtacttgcttattaaaatggaaggcagcgaaattgtaactgaaattgctttaattctttgatactttgatatcatggatatgactgatgcagtacggtacttgggacactcagtgcaaagcgtcgttaatgtagtaataaacagattcttaatagggttttcaggaaaataattatattcaatatgtatatctctgcattttaatcaactgtgtgtgtgtgtttgtgtgtgtgtgtgtttaagactgcccctgttttcatgaggtttagaaagaaatggaagattctggcccattttctgcattcctttagaagtgcatactgtgcatgtagagaggaaatgcatgattgttcctttggttcagaaagagttaaacactagaaagactgcctataggaatcttaggataatattcataagcgcatactagtttctgagaatgagtaagttgataaagaattatcgtggagatttcagagtttaaaaggaagatttttttgtccatttaggaaaagaaaagtttaatattttccagaattcgtcatatgcgaagtagtctttgtttctaagattttgggatgtattaatgcatctttgttaataatgatcttattgtagtggtaaatatcaacaggaatagcattgaaaaaggacattataagttgtaataaggaatctactatataatatccggttatgagccagtattactgttttgacatatcttcctaagtacagtattagcttttcttttcccacaatgtgtaaagataaggagataaactaactggcaatctaagtttgtaatgaacttgaaaacattgtatagcattttttataacacaagttaaatcacaaagagttaaatattgttaatatttatgtcaattttataaatttaaacaaattttggggatataatgcttgctgttgatatttacacaaatatgtaactctatcactgggaaactagtttgatgaaatttctgtttccatttcaaggtctggttgtatagaatttcctgccacttttcctggaaaataaactcctcatatattaaatttattatattcactgattgaaggtcctcatatccagggtttttcctgggttctgtgttccatcattctgtatactttaattttgatgggtccatctgaaacatctgccatgagtagcaaatggaacactggcagcccttgggttaatgcattttaagataaaaaagttgttatttcataaatattttctgagttttcaactttatagttagaatttgaagacagagaacatagaaacaattacttttaagatggttaatagttatggccattaagattttttattaacttggctttcattctctattgtttaaaaatgtgtaatggcttaattaaggtggctttttatttcgtttgaatttaaactgtgtgaccaaaatgcaaagttgccctatatcctggaaatgaattaaataataaggatgctacagaactttattgattagaatgagtttcatggattcagtactttaaatatcaactgtactttacattaatgaacatttttatttacattatatatagctctgaagaaaagtatgatagttatattcttaatataaaacattcaaaggagaaaaagatggaaactacatgaatctaagataatgagcaactcaaccaggagaggtcatcacaagacaaaaagtagcatgaaaatctaaaactatcatttttctttggtacacatttttaaaatgtgatgagtatgctaaaactttctgttcctaaatacctttttaatatgagggacagaagatgtttatttcacaacaactgcatttcaaatatgtatttgcttatgacttatttctttttctctgtcgacagacatataaaaactgttaatactatgtgttgtacaagcagactagaataaacttgaaaacaaagctcatcactatggttatgtaaaaatataatctaatttctttgcagatagcgaaaatgaactgctgctgagctgatgtaacaaatcgtgtatcttcccttcctgtaaatgtagatacacgggacacacgtgggaagtttaaagaaaatatttcactcttagggagttgcatttatttgaacatattataaagaccttgatggtgcagttctaaatgatgaggagattaagctagcgcttaataaattcactttttagagttaactgaattttcacttaaataaatgatctctcataaaggccaatttacatcatttagtagaactattaacctataatttcattgaccaacacatttgggaaatgtgttttgaattaattcacatattctctaacaaatacgattttatacgtgtatatatacacacacatgaatatatatgtgtataaatatatatgtatttgttcatatgttttataaaaacatttgaatacatgttataaagtacatagatacatatttaatatagcacatatattaagtattatatgtaaaaatgtgtatatttatatattttctaaaacaccattcaaggaatttaagttgtttacaagtttatagaaaggtctttttccagtgcaattattttaagtaactaacgcaacaatattaagcaatagtatattagtctattttctcttcctcaattcatatacttctcccaaaatggtgtattttaaatgtaaaatatgtaaatgcatataaaagcaaatactgctggtttatagagaccttgaacataataatgaacttgtcttaatgaaaacaatttaaacttaaaaggagctttaggcaagcaaaattcattggttgataaagcatagcacattatttgcttaatgcaactaataattattaactaattggagagaaatgtataatctcgattttattataggcacggatattcaggaagtaagaatcattgttcaaattttactctttaccatcaatatatggcaaaattgggcaaaaaaattaatccacaaatttaatttaggtcttattaacctttatgcagttataaacctacaacgtatcattttagatgatatcaaagttgtttggtgcatatcatattttaaatcttacagttatgtgccccataatgacatttcagttcaatgatggaccacgtgtatgttggtggttccataaaattataatggagctgtcatatataggtgtgccatttttcatcttgtatattatatttttactgtatcttttccatgtttaagtatgatgagatacacaaagaggcattgtgttataattgcctatagtattcagtgtaataacatgcagtacaggtttgtagcccagaagcaacaacccataccaaatagtctatgctatgtgtgtagtaggctacactgtctaggtttgtgagtgtgtactctatgatgttggcacaaagacaaaattgcctaaggatacatttctcaaaatatatccttattgttaggaaatgcatgatgatatatgttttttgtctattttaagtgggaaaacctttcaagttctataatttctttgagatttaattcactgttccttattagtaaattcttctagacaaaaacttactcaaatgtcttaaagtttacataaagcttcctttttttttttttttttttttttttttgagacggagtcttgctctgtcgcccaggctggagtgcagtggcccgatctcagttcactgcaagctccgcctcctgggttcacgccattctcctgcctcagcctcccgagtagctgggactacaggcgcccaccaccatgcccggctaatttttagtcttgtgaatcttttttatgattgaaagagaagaaatgtgacatgtctacacatgtcatctgtttttaaaaagtagatttttgtatttgttgtaaatggtatacagaatcaggagagaatctaggctcagaaattcttaattcaaatgtgcttttctttaaaatattaaacatatggagatccaacttgtgcaagttgtctgtttagtgattgatgtcagtgggatgaagaaataaaacatgtactttaaagattttcccatctctagtcctgatttgtgaagtgctttactttatcattttttactacttgcaaagttataaaacagcgtatatagtaattttaagcctcaaaaccagtgttgtgtgaaataaaataaatttttatatttatatctgtaccagtatctgaaactggctgttacctgtttctagagagacacatattttaagataagtagttatcagaaacataaggtatatttctacaaccagtattgggctgctgaaataaattatatgcttatttttgccattttaataagtaagaataatgatgcaatcatttatatacagctgttaattttcaaatgaaagccttgaaaataatacttgtaacagagtgattcactaaaacactggattttcccatctcctgggctctgtagaagctatatgttttagttctgagcagataaggatgttggaatgtggaggtgcttcctctttctccatcctaacagttcattttatgggaagaaatgtccgtctatcacactcttagagtctatgtctacagttcattcgttccttcctatgttaggtagagttacttatctgtttggtgactatgggaaaaggacctagatgtgcttagctcagcccctcctttctccttccaggctgcctgcagaaagaatagattctgctgaacgatagataaaagtaggctttgcctctgcactaatagtgatagcgcgaagagccttatggtgttcggttcttcctatggcttgagactctgtttaattttagaaataaggttaatgaatcccactgtatcacacatttaagccttattcttttgtatcagcaatacttatataaagaatgttatttcctctctgtgagttattttctaatctagaactcagagaagggactgagattgactgtactcagtaaaaccacaaatatattgaaattgccaaaaataagattgatattaaactaaatgaacatgaaataatttctgcatagtttagaaactagtaaagaataagacttggtttttccattgatattgagttgaagatttggtgttactctggttaggacttccaaactctcccattcattcattcattcattcatattcctacccagtgctatccgtggtattattttacagagatgcttagaataccgtttctttatctgtggtaaataacattgccatttaaaatacagcctatttacaaactttagccagtacacatccaatttcatcctgtccatgtaactatttagtaaattatatatgcctttagttggctgttacatcatgatccttctgtaaaatcctgaaggttaaatgttttaagccaattattctttccaacaaagcatttgcacttagaaaacaaaattgattctttcttcaattgtaagttttgaaaaatatcttcttaaactcttctttagttcactttggaggtagctattcataataacagcttgaagtaactgattttttatgacactgcagattttaaagcctcccctgatagtaggaaatctagatataaagatgtggttgttggctctgaatttgcttgctgaagatcacatattttgggtatactgtaaaaatgttgaaaaaatacagaggagctcctgggggccgtattctgtatttaccttgtgatttaggtttgcttgaaataccctcataaacataaatagtgatatatgctttaatgtttttatgtttaggaaagaggtgaaattagattctgagaatacttttaccaggaaaaattccccaaacatatataagtttttccttaccttttctagtacattcacaaccttcttcatctgcactgggatggtgatctggaaatgtgaatcatagaaaatggcaggcaatagaggtgtgactggcatacgcactgtcaaaattactaaacctgtgttgtctggaacatctaagatggaatcaagttacataaagtttagttaaattcaggaaggatttgttcacctctatgcattagatgtcatattgaaatagtatgtgaaaaggaaaatcttgcctggactcacaatttttatttactgttataatgtcatctatgctgttcaattatagtattatttgaaaggaatacatgaaaaaaataataggcacagtttgtattgttaaaaaaacagtctgttaagtggtgaaataccatgatatgccaaataaaataataactctaagaaaattgtcttaaaattaaaggtgcttctatttttaatagaaaaggcttgaaaccaacccaaatgcccatcagtaatagactggacaaagaaaatgtgacaagtacacaccatggaatactatgcagccataaaaaaggacgagttcatttctttgcatggacacggatgaagctggaaaccatcgttgtcagcaaactaacacaggaacacaaaaccaaacgttgcatgttctcactcataagtgggagttgaataatgagaacacctcagcacagggaggggaacatcacacacccgggcctgttgaggggtggagggctaggggagggatagcattaggagaaatacctaatgtagataacgggttgatgggtgcagcaaaccaccatggcacatgtatacctgtgtaacaaaccttcacgttctgcacatgtatcccagaacttaaagtaaaatttaaaaaaaaaagtgcttattgtcacttctatatcatagactgaagtagttattttgaactaacagaaaacacatgtggattaaattttatcactgttaactgattttttctaagcagtcacctcttaatgggaaccaaattattaagtaacataagtacagactgtctatatatatatgtctttttcagacattggtcaaaaatttataaacagaactacatgaaaaaatttcagcctaattatgtcacatagtgaaattatagcatattttatgggtcttatttttaaaaatttattaagtacgtgttaaataatggcctatgatgcattaaattacttaattgctaataaattctaacttaaaatgtaaattgttacgtagcatatttgaaacattttttggttcaaataaaaatatgtctggactataaaatatgactatcaggttttcagattatgaaactattatactagcttagtgtttttaatgccaaccaactgaagaaaacatgattcgggtgtttttttctatgtattcatagcaacaataacacaatgagttcgatgctgccatcaatactaatgttactaattctcatggtattttactcagtggatttgaatgtggccatagaatctttctccacacaatatgccagacagccacgtataatcccatgagatttggtattcaatataaaactttacttttttactcaagttatatatattgccaccaccagcagtttttcagctaataaagtatacttatgatttaagtcacttggttaatgtcctcatccctaaagaatatgttaaaacgaatgcttaacttatagtagaagagattttcaatggcagtaatgaaatttccaaaaatgaaatttaatcatgcctcatgcacttctgtagtatatgtaagttttatttatatatcttaacgtaagcatttaagttattaagttatgactagttaaaaggaaatagtagcatagttaattgtgtttttgtatgtccacagtacagaattaagaataactattttggccaggtgcggtggctcacgcctgtaatcccagcactttgggaggctgagacaggcggatcacgaggtcaggagatcgagaacatcctggctaacacggtgaaaccccatctctactaaaaatacaaaaaattagccgggcgttgtggcgggcgcctgtagtcccagctacttggaaggctaaggcaggagaatggcgtgaacccaggaggcggagcttgcagtgagccgagatcgcgccactgcactccagcctgggtgacagagcagagcgagactccgtctccaaaaaaaaaaaaaaaaaaaaaaaaagaataactattttattgtgtcagttgacaaaaatagtaccgtgtcagagataaaaatgtgccgtggtggggtattaacattgcttctaccattaagaacataaacaaaaacaaccttattccaatattctagatactgagggggttatttttgtggaattgattccaaagacagggatgcttgatcaaagaagatgtttagtttttggctaataaatgttgcctgattgagttccacaaattctgtaacaatttacattttcagcatcaatcaatgagtgtccttttctagaactccaggcagcagtacatattatacttataaaacgttctgcttgtattacgtaaatagctaatatttgttgtgttgacttcttattaaatgtttcttcccagcctttcaaatcaggcactactctttatgtgtactaggtcatttatttcttataacaatgcttcagtttgcaaatgaaaaaatcagagacacatggagaagtaacttccctgggccaccagcttggcctatttccaggtccagtgctcttcactgtggcatagctggctgagagtgaagtgctgtctctgtgttcaagttctctaactaagaagtttcagcttacatctaggcaacattttaaggcttgattgcttgtatataaaggaaaaagcctattggcataatgtttctatctttttgtttacttattccttgatgacactgtcatatgttctggagacttaaaaattacattggtaaaaaataaagaaatatatttgaaataaagagaggaatgcagctctttcaatggtagcacattaaatcataatatatatgtcatttttgttcttcttcacaataaggtacttttgcagtgtagttctatcatttgagtactattgaaatacatgtaatagtcatgtagtgaaaacatttatttaaagctatgtaaaatatttcttaaaatgctttgtcaggtatacataaaagctgtctttaaatcagttctcaggaaatgttgaagtctgtatcgaaaactgtaaatatgattgctattactaaagttaaaagatggtaattgtttaatctataagcacagttttgagtattcatttcatacaatagctaatccatgaagcttttcttgagagtgctgttgagaaaataactttttcctttgctttcatggcagtgggaaaatatttgtctttaaaatatttgccagtcctaatgcttaaatatttcttgtatccatccgctgctctccattcctatcacagcttctatagttaagattttcagcatttccctccaggcattaatttagtagcctcctggtatgtctcccggattctaatcttccccctctagcttatcatctatatctatgccagaaatactttcccaaaacacaaatcttgttatagtactgcatttctctagttcttccctgtctcttaaatttagtctcctcctaacccaacatttgcaccctataatctaaccgaccatactgagatctttgcagtttctctaacacaacatgctgtttcgaatcatatttctcttataccttgttacattttgtcccctcctttcatttttcctgttttatctatgctgttttagaggaaactcatttacggtccaagcctcagaatcttggagcagactgatgtatcaacacctccctgtggcaatttgctctaatcacaggtgaaatactaagacgcagcaggcaaattctttggtttctgaacttataaggaacacagtgatcacaaataatgaaaaccacctccaattatctgatattaaagtgagaaattaccccatagtatcgacaacagaaggaaggcgagaaatatattttcaaagaataaaccacaaatattttcctcattttataagtaaatgtgtatctatcataagggaaatttgaaaccatgctgtgaaagcttacaacttctgcaaccctttttctaccggattttattttaaaagattttctctgcttttcttaagccacatgggtgatcacgtgcctttaaacccaagcctgactgtcctttccacaagctattatctgaagaattatttgttatctgcatgcaaattaaagacgtgtcaacaaaataattattgcatctaacaagtactttaaatagagtacttaagatgtcaccaaatcttctaaatgatagctgtagcttctgaaaaacttgataactatatatatttagtgtgtaataatccagcagatgcgttgatattgttgaagttgttatgaaatgtcaatgaatttcatttccacttttaatatgacaaaaatataattttataagtataaaaatagttacttctattctatttgtttatattttaaactccgtcttcatccttacctttgcaacttagtacacacttctgaaccatttcaaagttggccagtctagcgaagcctgtttcaaattttatattcttcacaatgatccctgcagtgatgcctactaaaaacacattactctcttttctattagtccacaatctgcatgagcagagcctgtattttttcccttaggctgataggtattagggaatggttgtattaaaggaactagactttagtaaacatgtttcatcatattaggtactgtactggttgcattataccattacatgaaattagcccaaatacctctgtgctgtaatattcaaagtataaggatgctcaagcattttaaagctcactggttccatctttatacagttcttacttttgtcaagtccttccttgcattgatacagatttacactcccataaattccagccagtagttctagttgggcttctcaaataaaagcttaatatttacccaatattctactgccgtaaaatacttgaagacaaatatagaatctaattaaatataatttaagacttagtcgctactacttttatagatagccaactaataccttgaagacaaacacattccttaaaacactgtgatttatatttacttatgtcctccaaattacccaaatatttctaggtacacaaccagtgttaaataaatacaattgaaaatggaattgaaatgggttagctctgtatacaaattgtttcttaaagtgcttatagctaggttatagcaacaaatatacattgttgtgttttgatagctaaaagcatcatactaagaagtattataattgtaatataatgttagttgcaaacaagtgtgtctgtaagtaatcttggtattacagaaaaaaaaactgccttaaaacttacatatctgtatgagtcaaaaccaaaaatgaaacagaaatatttaaagggactgttgtttaaaagtaataggacaactacagttattttaaaagatagtttatacttatttgctcagtgtgaaataaaacatttttaaattttaatttattatctactctttgcccaaagtatattagaaaaatgttactgcaatttgagtagtcttcatattgtgataaaataggtaattattatatgcaataatctgaggcattttcgttttacagagcatataatcacccacgtatcaatttttggaatttaaaatgtgttgttggcacaattagaatcatgtatctactttcaaagagagatttcagaatattgcaaataaaaatgacattgtttcttttatcaaattggcatcaatagggcctttttttcaaaaaaagcttttagatctgctatttgttcatttatatgtgtataattacagtattcagaggatctctcatgctgtgtttgtttccacatatggattttcaaatgacaaagtctcaagtggtggcgctaaagacaaaccatgctagctactcaagcatttccttcctggagttgtactgtgtcaactgctccctaagaaatgggtaaagagggactactcagaaacatgcattgagcatcagcatgtttttgaaagattaatcttctagacctggaactaaaagtatcttccagttattttctttattatccactttatcagcttccacataacacattcagttttctacattttagtttaaaaattgccatttaattctatgcttctatgaagtcacatatcctacttatgctttcttaatttcaaaattatttgcactgtccattttataatattttatctatcttaataatttaccttaaagttctcttttattgaataggtatgacaacatagaaattaaaattattgaatcattccaattagtccacaggtaaggtcatcagtgagtgattaaggaaactctttctgttataacattttagctaaaacctaaagaaaaagccaagcaaacagcaggaaaagactgttccaagaaaaagaggacaacctcacaattccaacattggccaagtttggaagtcactttgatgaggagatatttagtggttttggaattagtcttctgttaaacgtgtaatgaaaagaaaattttgaaagagtaaattatcccgcttaattgtctatcagcaaatagaaaagaaattttcactggttagaaatataggcagtcgggccgggcgtggtggctcatgcgtattatcccagcactttgggaggccgaggcaagaggattgcttgaggccagaagtttgagaccagcctgaacaacatagcaagactttctctctacaaagaaatatttaaaaactagccaagtgtggtggtgtgtgtctgtactgtagtcctagctactggagaggctgaggtggaaggattgcgtgagccccggagttcaaagctacagtgaataatgattgcaccactgcatttcagccagctgagacaagagtgagactctgcctcttaataatttttttaaaaagaatttaggtcagtattaaagtttgtgataattcaattatatttagcttagagaattttgctaataaaaataactttgataatttaacacatatgtatgttattgaaacagcaagcattttgaagaggcaattttctaaataacctttatttcaaagtgtattgtttattgctgtgttagtttgttttcacactgctataaaggaataccagagactgggtaattgataaagggaagaggtgtaattgactcacagttctgcatggctggggaggcctcagacaacttacaatcatggcagaaggcaaaggggaagcaaaggcacgtcttacatggtggcagatgagagagaagagcatgaagcgggaggatccccacacttaggaaacaaccagatcttgtgagaattcactcactatcatttgaacagcataggggaaccatccctatgatccagtcacccccaaccaggtttcacccttggcacttggggattaagagggttacaattcaagatgagatttgggtgggttcacagagccaaaccatatcaatcgctgactttaaagaaaacgaataatattgtttccaatctttacatagtttcacataacatttttgagagtataactgtaacccaacatttacaatatatttgtagttattttttaatgtgaataaaggtaatatgactcatattcttaagaatttccccttggcattactatgttctactgtttcaaaagtttgcttactttaataagatttcaattatttggattgttaatacattgagatagcgactgaggtttattctctcatttaacttatttttcatcctataaatgtaaggtgtacaatataatattttgatatacagagtaaactgattactaaaatcagaacactaatatattcattatctcacatagtttttattagagaggtatgcatttataagctgccaacaagtccaaggattgttttaaaatgtatctttcattcttattacatttgtgacttcctgggttccatgccaattgtttgtttttaagaaatgtagtgttataacaagattgtttcagaacttcaataatatgcaccttcaaatagaatattataggtcttgctttataatttgtaaactttcagcatctttgcggcttaactttgcaacatacttcaaagacttaggcttcatctaatttgacataaaataaacaataaccagcaagtactagatgattatgcatctgatatggtttggctctgtgtccccaaacaaatcttatcttgaattgtaatttccacgtgtcgagggagggaggtaattggattatgagcgcggtttcccccatgctgttctcgtgatagtgagtgagtctcaatctgatggtgttaaaagtggcagttgtttcctgtgctcgaatttactctctcctgccaccttgtgaagaaggtgtctgctttcctttctgccgtgattgtaagtttccttaggactccccagttatgtggaacagtgagtcaattaaactttctttgtttataaattacccaatctcaggtagattctttatagcattgcgagaatggactaatacagaatctgtaataaactcatgcagtatctgtatctcagattgtatctgagattacagtctctgctaaaatacgttctttacagatgatcaatttacttagaacataggccaataagtggttatacacagatgtctgttggccttgaataatagcactggccattgtcagagttggtattggggaggttggtgtataaagagtacgaacttcatagagcagcaattctcatatgctaatatgcatataaactacctggcagattctgattcagtaaatctggagtggaacctataatgtaacatttatttatttatttgtttatttatttttttattatactttaagttttagggtacatgtgcacattgtgcaggttagttacatatgtatacatgtgccatgctggtgcactgcaccaactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgttttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgatgagcattttttcatgtgttttttgtttgcataaatgtcttcttttgagaagtgtctgttcatgtcctttgcccactttttgatggagttgtttgtttttttcttgtaaatttgtttgagttcattgtagattctcgatattagccctttgtcagatgagtaggttgtgaaaattttctcccattttgtaggttgcctgttcactctgatggttgtttcttttgctgtgcagaagctctttagtttaattagatcccatttgtcaattttggcttttgttgcccttgcttttggtgttttagacatgaagtccttgcccatgcctatgtcctgaatggtaatgcctaggttttcttctagggtttttatggttttaggtctaatgtttaagtcttgaatccatcttgaattgatttttgtataaggtgtaaggaagggatccagtttcagctttctacatatggctagccagttttcccagcaccatttattaaatagggaatcctttccccattgcttgtttttctcaggtttgtcaaaggtcagatagttgtaaatatgtggcgttatttctgcaggctctgttctgttccattgatctatatctctgttttggtaccagtaccatgctgttttggttactgtagccttgtagtatagcttgaagtcaggtagtgtgatgcctccagctttgttctgttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctttttgaagcaattgtaaatgggagttcactcatgatttggctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttacccattcagtatgatattggctgtgggtttgtcatagatagctcttattattttgaaatatgtcccatcaatacctaatttattgagagtttttagcatgaagtgttgttgaattttgtcaaaggccttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactcttttttataatgtaacatttctaacatgctcccagatgatgctaatgctgagactgatctatggaccacacattgagtagcaatattttaaactttgaatctataatgaaagatgtcatagaaaatttcctacttattttaaaattaagaagcacactttagaggaagaaaattttaaaaatatataattatgatatctcatttttattttgggtataaatagaaggtataatagtgtagttctatgatatgattagacgaaaaaaattcagaaagatgtagatactccactaactagttggatagccttagacaatttatataatctctcagagtttaagtttttgtagttatgagagaataaaactagattatctctaaaatccattccagtttttaaatctatgattctagtctcctaggcttctgagtctgagaatggagaagcacctcttataaacctcagtcttgcttttatatctaactggagatttggaatagagtttccaggttatttatgaagtttaaataatattatacatatgagtgtggtgcttaacaaattgccttaccaataacaagtgcctaactaatgttattaatgtttcctattgacaatatttttacctaccttagtaaaactgaatcttagaaagtgagttaacttcttccaggacatacaggtttctagacatatgctgaatcactgtataataacaaaatacctatgtaattgataatatattagaaatatacctttaaataaagccagtaattataatgaaataagaaaaataccaaggaagaaaaaaatgcttgtctctctatgttcaagctggtaaaattccatcaaaatcaagctaatctcaattacccaaatactctgtcctcttgtttgatagtctgtgtgtgcatactcctttttattctaatataatagtgaaaatattaagcttaccgatatgtaaatagcccccaattatattgtgtgatgtcatgtttgtaaagcacacattcatttactaaaattattcattgtttattatttatagctattatttctactaataaaaagcatttccacacatgagcaaatgtatcaaaaaaagtctaagaagatgatcagattgatcagtgtactctatgcccttcttaatagtaactgagtgtgattttttacattgcatactgccagaaatcaccacatgtagcatggcagatggctgccaatagtcttgttatcctttcataaattatgtggcatttatgccattagggtgatttttcagtttagaaaagacaactaagggtcagtcttttctatgataatggactcacaagggacctcaaaactttaccatgaacatattttatatcttaagttatcttccagagactttgaatgtttgaagctggttgaggtcgggaagtcaggacagaagagggagtagagcacacctgctctaagtataggcatttcaacgttcagaggaaattagtgtggcgtggaggggcaccaggggtggtagagagttcatgctgtgctctctcgaggttggattctacagaagctcagcgttggtgtgattgttggttagtctggtgtggtttggtttggttctttagtaggtggggcccctaagaacctgagtaatgtccccatgcactagttctgtaaacgcggaagcaggtggtggcagttaagtgactcacactcatttaggctctaagccggccctctcattcaatatccagcaattcgatttctactgttgggtttacgttgctttgctagtctggggcctgcttcgaagtgtcaaaatagcagtgccattgttcgtggtgaatttccagcaaaagaaacagacagaatgttttagcaccaagttgtgtgatttgagattaaaatgctctgcatggctattcctcatgatggcacttttgagtgattactacaagaaaaacgaactgttaaaatttgaaaaggggaaaatgttggatacagctcaaatgatccatatcaactactcagttattcacctgtgttaggtatttcccaacttttcttggggtatcctttatagagtagcctttgtcaagtctcataaaaacagaactaatatacttccacagtatgcagtattaattttatatttcgatttgctctgaaactttgttctctcttgagactaacaagtaaatcataaagtgaatatttttcaatgtcgaagttgttctgaaagtataattttaaaagttctttcgggccataatatatgcctttggagaagttaatatattattgaaatatctacttatttcatctgccacatgaaaataggactgtttcatctgtccttaaaagcaaggtggaatatttgcttcttttgaaatgtctgtggcattttttttcttttgcatattctgcaacacaaagaaatatttaggacttgaaagaagaaggtgagctgcttgattacgctgtactagcaaactgtgaatttatgttatttacaaattataattaaaagcctaagaagaaaatgcatgcattattttatttaaagaaaagcctctgcataaaaacactcatggaagagttattttcaatttaaaaaatagatgattatgtgtaccataaaatagatgatttcatgtaccataaactactatagtaatttgccaagagataagaccaaggttaattttttttcaaaattaacttttaattacaatttaaattaaatcactttaagtaaaatcataatttaaaattattcttttaatcaaaaggtttttattttaaaaataaacatgtagaaaagaattatatatacttaatatttaattctttaaaagtttactgaaaggtcatctagttacttcttaatgagcaccatatttaaatatatttataatgaggtttgggtttttttattcttttcaaattaggtttaaatatttttcagttaaatttggtttttgcaaactacattccttgcacatcatgaggctaaagccagatatgtgacataatataagaaaagcatcctaagagagaaaacattctcaagctctaaaactataaaactttaagtataaattgatgataaatgtcacattgttattttaacattttttgtctgggaattctatgaagaagtaggtgcaaaatgttactatgtggaaaatgtaatgtactttgtgcattgaattttaaaatgacatggaaggtctgaagaacacagaaaggttgacagctcaccacagatttattaagtatattcaggtttttatctcaagatttttttaattacttgagtgttggtattgataaatttgttgttgttattactgagaacttaatatgttactatgtagatttcctaagttctctttcaatattactactgaatttgtaaatgataagtgatcatgaaataaacttatatgttgaacaatatagaccatatcattcacaagtattagggacatttcattatgggtaagaaatataacctttggacgtgtagaccttgtagtccatttcagtttgactaatcaacatgttcagtttataacatgtttgatcctctatatctctaagaatatatgtgtttttgtgtgtgtacatatgtgtgtgtgtaggcagattttatttagttgatatcatggggaaatctgttgctcacatagttgacatttctttataaatgcaactcacctcatcaaaatgacataccaaaagaactttaagaaacacatttgtaaatggcttacatattctatgctttcttaacccaaccacagtgtaaaaataattctgagtactttggaacataaccacaaacacttatcaaatatatgctccccagtttgcaattgggtccctataaatccactgtaagttgaaaatatagttaagtcgaaaatgcattgaatacagctagcctacagaacagcatagctaagcctcacctaccttaaacatgctcagaacactgacattagcttaaaacaaggcaaaatcatctggcagcatgatccactatagtgtattggttgttaaccctcgtgattgcgtgggtgactgggagctttgacccacttcttcctcccagcatgtgagaaattatgataacacagactgcaagcacagaaagagatcaaaattcaaaatttggagtacagtttctaccgaatgagtattgctttcacaccattgtaaagtcaaaatatcataagttgaacccttgtaagttaggggtcatttttatgctattttaattatgattgcaatgaccaatcaggtctgtggagctgttttttcccaccacaaaatggcttaagagtgctgtattttgctatcttttcttattgatattagaataactttttgactgttgacacttaaatttaaaagggtttctaaaaatcaatgagaaagattatggaagatgtgtttgtattagaagatgtagcaaacttccatttgaacaaaactctgcccaccttaagagtttcttctgtgtttatgattaatttgcttcaagatttctgtttgtggctgttgagttatcattctttttttttctcagtgtgctcattccttcattcagtcagttattttaaaaaatattaatttgttgcacaaatgtaatatgtctttgtataagacagacctaaattcaactaagggaccctatttaagaagtttgtggaaatagaagtgtttttaaggtccataaacatcagttttctcatttgtaaaataattggggcaataatacatgcttgagttcatagaaagtacatagcacagtgaatagcacaatttggggggtatttaacaaatgtcagtcatctttgcattatctttgtatgaaattaacatgtaattcataagcagttttaggtatctagcatttccattagctccagcgtccagtcaaagccctctgttggaatatctttgcagctacaggagtctgacttgatcaaatgtaacactttcatacctgtgtccctcccaccctttcatttgcttgactggcttctttgtatcagactatgactcaatggatttttccttttctattgctgaagaaagctccatttccaaaaattccattcaacaattcactacagcagacgacttataaaagagaaaatgagatatcatcctgtgttttcaagagtagataaagaagtagtagggttcttgcacagtcccagggttgatggcagagtcttcttcctgttcaatgtctcaagtttcatctgtccatctcctattcatgcacactgatgccatcctctgccatgctccctcatcacacttttgccacacgtgtctgtcctgaggcatctaatgtctgtggcaagtaaagtctcagaaccataccatgaagatctatggtgaatgaaataattaggtagatactaagacagagcatttaaaatatattctcatatattaattctcattcttagccattaaaatatttgtacttcaagtgttcggcttgaggttgaaaaatctgaaggactgacagcatctctcattatttcttttgggtagttaataaatgcttggatttcagttcttgatagggacaaacgatattttgttgataatggatcttcacttaaatcccatcatgcaatttactctctacatcacaaacaaccatgcgaagaaagaaaaagaatcagtgatttttctcttccctctaaggaagagattttcatagcggaaacaaagggaatattttggaaatttactgtggtgattttctggattattatgaagggggtggtggctgttgacatttagagggcgaaaatcggaaccactagaacatcttgcaatctgcacgtctggcctaccctacaaagaatttcccaccacccagtgactgtaggtttgtgcaattgcaaaatctctttacaaatttctgaatctggaaacaaactcaaatttgtatgtagatacaaagtatattgcatagttttaatgtgcactaattttctaaatataactacagtgtcagtggaggaaacgtactttgctcaggtcacaactgttttcaccatttcagaaagtcacagataccaatgctgctcatggtgtctaagtggcacaaagggcacctgtgtgtcagcctacatttgtcgttgttatattgaaggtgattctaggtgtgagtaaaacatctgactacttgattatgtcttctaatgtggtggtgcttgaatgtttacatatcaatatattattcgtgtagatcactatccttttattgcattgaaacaatgtttaaattttgtgtgtagatagactgtattttttatggatttacttcaggctgagggacagattgttctggtagccatttgttacttggttgtcaagaagcaagctaggttgatggtgaaacactataagaaatatagttttcattttctttaacatttgtatataagtgttctatatttaaataacaattacataattaaaagttttagattcacttgtgaattatttattaattgtaagattgtacctttcaagaaaactcaaccttattttttcctactttaggtggttttcttttcaagcattaaaaataatgttattgagttctattgatgaagttaaaaatctgatttccttttattttataattcattaggcattattacattttcactaaagttgcaacttgaaaattcctgtaagacacgcatcattccatataagaaaaatgtaaaattcaaatattgtgcaactcaaggtaaatttacaaaataaatttagtaagcattattaaagactcatagcctttaggttactaatatttaatattatagtccaccaggaaagatgatctcaaagagggctcagtattgatttgcttgttggtatttcagagatactgacagctgctatgacttctgctgttttttcttaactttgcccatactgagtttgctttgtatttccttgttattaacccacatctcaccatattgcaattaactttcacaataagcactccattgaatatattagaaatatttgcaatgtgaatagaaactcttaataagagcaggcctgctgctagatgataagaggtctgcatgaattagaaaaagttgcccttccatatcctgaacagatgtagccccaaagttcaggggttagtgaagagagggcttctttcttcactcccctcattcttttcctctggggagacactgtctttcacaacttcgtggacagcatgtggactaaatttcagacagacacttgccccttcagtgaggcatctttgtgcaaggtacaaactttatacacaggcatgatgatccctaacacaaatgtgtctatgaaagaaaagagaaaaataaagaacacccaagttttcatgaaagagcagttatacaggaatgaaagaagctttctaacaagaaggaaacagttgagagggaggaattaaagatagaaaaatctattgatagccaatctaatttccctgtttttaaaattcaagggtgattcactctaccacttatgagcagaaaacaaaccttagaaatagattacatgattacgatctatgtaaactttcacttcgtattaccctaattgggttctcttctaattctgtgtaaaataatacatcttttggtttatggtaagagagagccatcctactatgactgccaaattttgattattcccaaattgagagacaggaaggaaagtgtttacatttatcatattgtaaaatttgaaatatgtatttatagcccattttagaaatgtttcaatgtaagaaaatgacttttaaaaagaagtccaatgtctagaaaggcatccagtagttagtatgactgaagtacatagttagtttcttaagaactctgcctttttggtatttttccttttagggaataaataaaatcaagcctctcaaatgattttccaaatccagagccatgaagttacaggatgatggattgctaggctgccattgttatctgtgtcaatggtggtcttggaatcactctgtgtggctctatgttgtggccctctctgcacctcctaaagaatgacttcattgctgtttgacttttcaaatttccttccaaattgaaaactcaagacatttttcttcacattttattttctttttattatgccagtttaaaagtctttgaaaataaagaactgaaactcaccttcttctgaagtcgcaagtgagcaaacagaaataatggattggactttgttaatgatatgcctaaaattagatgttaagttattaaaattttagttttccatgaataaggacaaaaacctcatttctaaaaccttgtcacatttaaattacgctgtctcatttgagtctccagaaaattatgtccagtcttctgattgtcactcctataaacttatttttatttaaatgacataacctccagaagtataaaatgttgaaattcttttcagaatgacttgcattatagcttttccctcctgtggtattgaaatactatgtttcatattagaatgttttcaaatatctactctcctaaatagattagttaatggtattgtgtttcctgaaataatctgtgtaatgaatacgaacatttctacaataagtttacagtcttcttactttagagtatcatagatctaaattctaatttatttttttttttgaaatggagtctccttctgtcacccaggctggagtacagtggcacagtcttggctcactgcaacctctgcctcctgggttcaagcgattttcctgcttcagtctcccatgtagctgggactacaggcatgtgccaccatcccaggctaatttttgtatttttagtagatatgggtttcaccatgttggccaggctggtcttgaactcctgacttcaggtgatcctcccacctcggcctcccgatatgctaggattacaggtgtgagccaccatgcccagccctaatttactttcaataagcaaaattacactttgtgtcacactttccccacacacaagctttttgtgacttcctaaaatatttatttatttatttatttatttattttgagatggggcctggctttgttgccccagctggagtgcagtagtgtgatctcagctcactgcaagctctgcctgccaggcttaagtgatcctctcgcctcagcccctcaagtagctggaaccacaggtgcgcaccagcgtgcctggctaattttcatattttggttagagaggggctttcaccacattgcccaggctgctcttgaactcctgagctcaagccttctgcctgcttcagcctccaaaagtgctaggattatagatgtgagctactgcaccctgagacttttaataaatttaaaaaacaaaaaatagaaaacaaacaacaacaacaaaaaatttcattccttcctgttcccaggctaaaattactcttttgagttagtggatgagtgtatgtgtaaaactctagcttactttgctattgctgaatgggctgttgttatagccattgttattcattgacatttcagggctgagactatgtcattctagaacttcgactcatactctcatgttaatttggtataaaagaaacataatgaagaaagtgtatttatctcattattatttgttgtgttgtttcttcctgcctctctaaatcccacttttttgtacaactaattttttctttcatcaacttttctattaacagcttttgactttataactgcagctaaatggatgataaaacaaaataaggtgtgacacaaagaatgaaacagtgaatggaagggcttaggtataatggaaggaaatgtcaggaagaaagtcccagatgacttttcaaaacttcagggttggcagtagctcatggtgggagagatgtaactcagttgatggatttgatgaattttgtccaaacgttggaatttggactggtcagatacaacagaaagcccccagacagtgactctgcaaaataaatatacaaaatgtgatcctgacattcagaaactcatctttttctgagatgctttaggccatttttcgtgattgaaagaaagcgacaacagctctatcccccgtgtccatgatcagagaaagagaaagaatgaagattcaagggccgaaagcgtgaccagctgagtcacatttgaagccttcctgaaagcctcactcagtgacttctctttaaacagctttagctagaatgatggcacctggcctctcttacttccaaattagacgagaacatactacattttagctgggcacattactatcccaaaccaaactggggtgctattagtaaggaaggaaaagagtagatactgggcaggcaattagaaatctttgcagcaagacattcgggaaaggtattatttagaaaagtaccaaagtctttttgtgtccttgatgtggattgaatagagtgagaaaaattgcctgtgtgccggtttcccagtggaggtacatggagaaataagaattgtttccttctgcatggtaagcagctctccttgtccaattgtcccctattactgaccatggtcccacagcaatatagttctatttctaggaatggactaggaaaaaaatcccagaggagaaactcccacactgatttctacttctaaaattcaatgtatttgtacctcgcgtctctagaaaaattgtgttttagtatatcagcttttgaagacagctgtacctaaatccagccatccaaatgggacaaaggaagcagactttcaccttcagaagcagccatgagtttgtgtctgctgcattgcactttcaatatctaggacagaatttcatacttattatataattacagtaatacaatttgttattaaatagttgccaaacaaaatagaaatacaataaaaatttaaaccactaacctttaaatgatatattttgttttaagaatattgttcagctcagatatcagcagattaatgatgagtacaactaaaccccaatcagttgaaagaaatgtataacatatcattttaagatctctgtagtaatttattttttaaaaggaacttaatatcgtggattttaaataattgaaaatattttttacacttggactaaatgttcagatgatttttattatgcaaacatcacatctaattaaagatatttcaatattatatttcaagacattcagtaaccattcattaagggctgaatattatatagtgggataaactaaggccatagaatatttatgtccccagccataggaagttcgccatttattggaggagataaacacacacataactgaatttggttttgatcttcctctgacctattctattaattcaataatgtaggcctaatcattattgatatactttattcttgtcaagatttgccacattatttgccttgaagttatttattgcaaagggatttgttctctttaatggatggctctgcattttagcatatgcgtttgtctttgagaaaccaccaagaccaccaggctaagacattgaataattaacttgacataatatttataaagtagtgagctagaaagttttgaaagattctattaataaaaatggttcatcaaatttcgggggcaaatgccttaaacatttattaatagctaaacaatatatgaacttttcctgaggaagaaaacatttcttcctaagtagtttctaagtagtaaagtctaatccagatcttgttatatgcactgtagagttcttttttcagaaaacaacattgcatagtctatatttctttttataggacaggcagctgcgttagtgaatgattcactaatggtgcgaagtctttctgtcaaacaaacacacagttcacttagttgggcttcaagtactttagtttttttcctaaacaataactgtctttaaaagaaagaagctgtgtaaacattgaatacagactttaatttaagacagatgataacccggaagtgaccacttctctttatcatcaaaataccgctgaagccccagtgattcaattgccaggaattcttctttgcttgaatttgatcattcttctttctctttaaaatactgttgttaagcactggatcggcaatgtggcattgtctctagggattgaattatgtttaattgggaaggaagcacactctctcttgtttttagttcataaagtaagaagactatcaattagtaggcagtgcagcccaattggagccacgctgcactacagacagtttggaggagattcatagtaacaaacaagatttaaaatacatgtcttgtgaaaggccattataggtggatggctgggtttttcctgtcttttcatgctgtagcagcattatattagaatgtgaaggacactcatatccataaaataatggctttcgtaatgcagatgattaaagtaggaagcctacccacttctatttttccctaggcatataccaggatcaaatttcaattagtgacctaggaactgcaggctctgtattctgttatcaatccctttagccagctagaatcaaagattcacctgtcactctagactctcagtgactctaaggaggatttagaatagacatctgctctatcctgttacgttgacttctttatactgtctgtctacaaaatgcattatgaatatacagtgaacattacaaatattctaaggtccattaggaaatttcattttctgtggacaaggattttaatgttaaatattgatagtgatttctgctaatttattgttgatttgctaaaccaggccattttacggaaaaattttaaatatgccctgttgatcaggaaccaatatatatatttttcaaagtgtcagaatggttaccttgaaatcatttttagatatgaattgcagaattcctagaaagaaaatatgctctcttataggactgtgctttatcaggaaatggcaggttatctagttatattttaaagataccaaatttgtttagtgcagattttacttctatagtgctcaccttgatgagcatcacaatgatgttcttttatttttaaaatgatgcattataatcccattagagcctttgccaaccagtaaattattaataagacgatgatcatgctaattaagctactttattagattttgatggattttgtgccagaaattatggtggggtctttgaaatatatagagtattttctcttagagcaagtcgtctagcatcattgaaaactttactgaaaactcttcattactcataacattgctcgtctgtttcaaaatgacacgatagtcactttcacagaaacataatagtatgcaattcaaatgtttaatttgctgctgcaaaagaattcacaatagaattctcaatgtggggttaattacatagtaatgaaagagtaaacctattgggaaaatgctctaagtaacattgctctgtttcctactgataaagacgtgcacgcctgatttattttttatgctgggaaattcagaagtaagagaaaaccttgaaaaggtatgcacatgaataataaagttttttatcatttgtcaacatgatgagaaaatgatgaacgtggataattattatattacaaaggctataatcacaaaatagtaatgtataagaatatagcattctattatacacaggagaacatgatacattaaaatcattgataacataatctaaggaaagacatcgctaatcagaacaaaaaaaggaagaagtaatagagcaggcactcaaaattgtgtccatgttttctacaaataatcttcaccctctctgcctatgagtatagtgttatattgctaggtatgttatgtttactccatatatgtcaaagactccactgggggaattgaacaatgagaacacttggacacaggaaggggaacatcacacaccggggcctgttgtggggtggggggatgggggagggaaggcattaggagatacacctaatgtaaatgacgagttaatgggtgcagcacaccaacatggcacatgtatacatatgtaacaaacctgcatgttgtgcacatgtaccctagatcttaaagtataataataataaaaaatttggaccacaaaaaaaaatatggtatcttaataaatatctcaaaacagttataagattgacaatatgatccctactttgttaggtgaagaaaatgacacttttaaaaacataaaaagatttcctgtatgataggattcaaattcatatttgtttgtttccaagggctttttctcattcattatcctatgctgtcatgtaaattaatccatgaatattgcagcttgtatcagaagcttgaaagttcacagaaagaatcattttctacctaaatttgcccatcaaatttgggtggacagtgacagcagcacagtgttaggcttacttttaaatgacattatttaggatagtgagaggataaacaaatagactaaaagaacagaacggagtccagaactagatccacgcagatatggccaattgatcttccaaaaaggcaccaaagtgatgtaatggagaaaggaaaattgttttaaccaccagacctagaaaacttggtatccatataggaaaaaaataaatcttgatacttcataccatacacacaaaagtaattatagatggcacatagacctaaatataaaatcttaagctcaaaagtttctagaagaaaatatagaagaatatttcctggacctgagctaggcaaagatttcatagaaacacacaaacagcattagccacaaagaaaaaaaaaaaaaaaaaaagaccagtcaggcttcatgaaaaacaaaacaaggaaaacctgtgctcttcagaattaaacaaacaaacaaaaacactaagagaatgaaaaagctaagctatgggagaaaatattcacactatatatctttgacaaagcagttgtacccagcatatataaagatgtcatacgaatcaattgtaaacagacaacacagtaaaaatgggggaaagatttgcactgtttacaaagataaatgtctgataagcacaaaacatttaatgtaataagttattagctaaatgtaaattaaaagcaaaatcaaatactattgcacactcactagaattgctaaaattacaaaagattaacaataccaattgttggtgaagaggtgaagtaactaaactcacatactctgctggttggaatgaaaaatcatgtaactttgagaatctcttgggtaataactgacaaagttgagcatatagtcaccctatgacacatcagtttcacttctaagtatttactctgtagaaataaaaacatgtttacaacaggacttgtaaaaatatgtttttaataactgtttacagagagccagaatatattgcctaacattatttttatatataaaggttacagattttttatattaattttatatctttgtagattttttatttcttttattttaatctttagatctactactatatcacctacataggggcaatttaactcctctaattcttatatttctgattttgattctataattccttttattaatactctcaatagaacattaaatagtattgttgatagtggcccaactttaggtagaaatctactacattttttgaattgatgaatgaaaaattattttagacaatgtggaatgagtcaataatgcttattaccatatatatatcaccactaatctttattattttttgtaatgagaatatttaagatttactctcttattagtccgttttcacactgctataaagaaaaaactgcccaatacagggtaatttataaaggaaagaagtttaattgatactctattgagcatggctgaagaggcctcaggaaacttacagtcatggctgaaggcgaagaggaagcaaggcaccttcatcacaaggtggcaggaaggagaagtgtgtgagagtgcaggaaaaatctaccatttgtaaaaccatcacatttcatgagaattcatccactatcatgagaactgcatggaggaaaccacccccataatccagtcacttcccaccaggtttcttcctcaacatccggggattacaattcaagatgagatttgggtggggacactaagcctaaccatatcattctcttagcagttttcaactatgcaatacattattattaactctggtcatcatactgtacaatacattgtgagtatgtgaatatagtactcgtacttattcttcctgtactaactcaaaccttgtaccctttaatcaatattcctccatttggtgccacccacccaatacatagtaaccaccattctactctctgctttatgaattcaattttttttttacattttatatataaatgagatcatgtggtttttgtcttcctgtgcctggattatttcccttagcataatgttctctaggctaatctgtgtgttcattgaagcgttatttgcaatagccaaaatatcgaatgcaatgtaagtgtccatcactgatgaatggacaaagaaaacgtgatatatatatatatatatatatatatatatatatatatatatatatgtatatatatatatatgtatatatatatatatgtatatatatatatgcgcaatggaatactattcagccttttttaaaaatggaggaaatattttgagaacagtcatctacaaattttattttaccatcattgtttaatttacattattacttagaatagctatcatcagaaagacaaaagataataagtcttggcaaggatgtggcaaaaaggaaactctcaaacgctgttgggaatgtaaattagctcagccattgagggaaacagtatggaggttactcagaaaattaaaaaaagaactaccatatgattcagcaatgtcactactgagtatatagtcaaaggaaataaaatcagtatgttgaaaagatatttgtacttttatatttattgcagtattattcactatagccaagatatggaatcaatctatgtgtccatcaatagatgactggataaagaaaatgtgatgtatatacacaatggaatacaatttgaacattaaaaataatgaaatcctgtcattttcaataatatacctgaacctggaggaaattatgttaaatgaaataagccagacatagaaagacaatcactgcattatctcactcatatgtagaatgtaaagaagttgctgtcatagaagtaatgagcaaaagctgtgtttacaggcgagggatggttggggtactgtggagactggggagatactgatcaaaggatacaaaatttcagttagatgggatgaataagcccaaggggtctattgtacaacgtggtagctatagttaacaatatattgcattcttgaaaaatgttgaggatggatataaggtgttttcaccagaaaaagaataattatgtgaagttatccatatgttacccagctggatgtagtcattccaccatgtatatatatttagaacatcatcttgtactgtgcatggtaaatacatacaattatatctgtcagtttaaaataagataaaataaaataatataattactttaaagcttgtgaaggagtcaccacatggacaatataacagaaaatctctgctagattgaactttgtgatgaacacgaagtacttaataaacatatttctttgatctgtctatgcatggatcaatctgttcctgttgaggaccttataacttcctactgctcactcaacaggaaattgttctgaaagtgctctacccatcaaccttcaatataaaaatatacattttatgatttactcccagagttttgcagtggcacaactttacacaacaaatttgatcaaaatagaaatacttcaatcaattttctttggcgtaagtcaccttggtacttgtcctcatagggtttcgtgtatttcacattgagttgcatcatagtaaaatcaaggtgtatatcattcctatttccatttcacaaattatggaaatgtttcatgttactggttttgttttgctatttatttcagtgttgcttcatggaaaattgaacatagtaattaaaaatgacaaaattttaaaaatctatcatcttgaaatttgtacaatgttttcatgacattattaacaaaactaattatcgagtacagttacacgttccaaccagagctatgttgaactagagtacacaggagagctttttagtatgaactgatactcacacgtaagaattgcttatattttaggaagcgtggccaaatttctatatgaaacatccacttttacaaagtctgactgtattgttgtttatttggaaatagtagtcaaactgtaacaaaggtggaaaatcttttgcacggctgttgagaaatgggtggatcacgtagaataaggcttacaaaaccactagtgggttagcagccccaaacatctgagactatcagtacaaggaagaaatctctatttctgtagcctctgatttgctctatctcatatggagggcctaatgaaggaaagaaactgcattctaaatgatgcagagcaaataccctaaaagggaagtgcttggatctttattactttggagacctaaaagacaatgtactttgaagttagtttcttctggttaatctcttttacttgatgtagacacattacataaatccattgtcgtatgaataatacgtaacagcaataatctattatcataatgtttttaggtattcataaagtacattttctatgtctaaaggaaaagtagcagattattaaacttccagttttattttatgatctgctctgcctcttcaattcattccacctttttgttttgttttgttttttaaatacattcatatgaatgtatttttcaatttcttaccaaagaagcaatttggaaaacactgattgttcatttcccttttacctccttgtttcaatttatgttttgagtacagtacattagtttatagagactgtgattgaaaaaaaagagcttacaatcttcctcagatagctttgctctgagttttacaatggatggtttggaaaaatagtgtaataatgactgagcttctaaaatagtgaagtaacagttatttttgtgatgtaatatagtgatgtatatgtggctcaaaagggttgctatatattccccccaactccaattttatttttaatttttggttgtttttcagttttatgcaagacttgctatacctaattctacaagctatacagtgttttttaatattgattccagaatttgtttcatcatatgcaccagaacaaatacttcagtaaaacttcttctgcactttcttagacaaagacagcatgatacaggcacagctaagtctcttaagctcttaggtatccttaaaacattgacaaggaagtcaatattgaatttcagataacaactggaattttgacagtactcattagttagtttggtctgacccaggcttccatcagtgcaaactttatgccccaagagtctcacaaagcatttacagcatatgctacagaaacatagaaagggagcaggcaactggcagagtatgggcatgaggctgacagctcagagatgccactggacctgcctcatcagctctctgggcactactcactcttctgaaagtatttgaaaccttttgggctgttactttacacctggtaaaaagcatctatagaccagaagaacctgggaagagggtattccttcccttcagagccaaaacagagagttttatactcttcagggggtttccttcacaagacagttactcacaaatcaacgatattgaaattgtatatctgggatttgccctctactgtcactcatattgttcataagaacaggaacagataatatttattggtttgcaaccacacatagatataaactctaattgcttcaacagagttttatggtaagaattgtttagtactaccatttcacagatgagaaaattgaggctttgaaagcctgaataatttgtgaaaagatacaaagctcctatgtggtcagactggaattttaatctacttgtacctgacattggatcctagactcttcaataggttacacttccttcgaactgggaaaaggtagcacaaatcatttatttttaaatcaccgatactagttttgttgtttaaggcatttaatctaagttgacttccccaaaggactgtgcagatgttttctcaaattaaagtgatatttcagaacaacaagtactagaaaatttaattcaactaaacagtaaattctagaaactgggggatcttttggcctctcatacaattttattcgtataactatgtgtcccggccagtcatgataacatatacttgttcaattgataaaaactgaactgaattcaagtcatagacttactgtagaggcttgggcacatttgcagaatatacacttggaatatgcaatgaggaatagaggttaagaagaaaggaaataagtaattacataagtaataattatatagtaattacataagtaaatacaattataaataattgcataaaacaatatcattattattattattattattattattattcgaaatggagtctcgctcttgtcgcccaggctgaagtgcaatggcgggatcttggctcactacaacctcctcctcccaggttcaagtgattctcctgcctcaacctcccaagtagctgggattacaggtgcccaccaccatgcctgactaatttttttttgtatttttagttaagatggggtttcaccatgttggtcaggctggtctcaaactcctggcctcaggtgatcctcccacctcggcctcccaaagtgctgggattacaggcgtgagccactacacttgggcgacaatatcattattataaatacagaaaattcctgtttttttatatcagtcatcctagaacagagacgctatcagctcctggggataactcttcccacatcgtctggaacataattatatttaattaaaacctgaagtggtatctaaagataatgacaaagtattaaatgtgcagagggtttcagtctctcaaacaaatgtgagtttgttactatgttatgtaccatagtagtctaagggctattatgttgtttcttacattagtgtaaccatggtgaaaaccaaagagaaaataaagaatgattgttcatgttttaatgtataagagcacattgatacattgtaaaacacccagatcagttatttaatccatcttttgaaatcacagaagaaaactggtgatatacatgtgatgaggaatggcaactgtagtgatttatattcctctaattttttgcaaaaaaaagaaagttcactgaaaaaattacaactttcgcctatgctaaacttaatttatgtaaaatagtggtcacagctattaaattattgttatttattcacaaagttctcctctacatattgttttaaagtaataactgctttacagcatttttttttaaatggagtctcactctgtcaccaaggctggagtgcagtggcacaatttcggctcactataacctctgcctccagggttcaagtgactctcctgcctcagcctcctgagtagctgggattacaggcacctgccccacacctggctaatttttgtatttttagtaaaaacaggtttcaccatgttggccaggctggtctcaagctctggacctcagataatccacccgcctcgacctcccaaaagttctgggattacaggcatcagccactgcgcccagctgctttacagcatttttatagacgctcttctttgaacttactaagagttcattgaaatcagctgtgcagagtttaaatccagcaaggaaattcaggcacagacaggttggaggtaacaaaaagtaaaactggaaagtgaatcaaattttggctgaaaatttaatatatttaatagtatgtatgattcctcaatctaacttaggttaaaataatcaaaaataaaataaggtgaactactttttttttaatgggcaaggtggcagaaatggaatttccaaacatctagatcttaggtctttattattctaagcaatttttaatacaatttgagaatctttatttctgtactcttcttcaataataacattaaagcagaaggaggttccaagatggccgaataagaacagctccagtctgcagctcccagcgtgagcaacgcagaagatgggtgatttctgcatttccagctgaagtaccggcttcatctcactggggcttgtcagacggtaggtgcagcccacagagcagggtgggacattgcctcatttgggaagcacaaggggtcaaggaattccctttcctagcaaagggaagccatgacagatggtacctggaaaactgggacactcccactctaatacagcgcttttccaatggccttaggaaatggcacaccaggacattatatcccgtgcatggcttggagggtcccatgcccacagagcctcactcactgctagcacagcagtctgagatccaactgcaaggtggcagcgagactgggggaggggcgtctgccactgctgaggcttgagtaggtaaacaaagtggccaggaagcttgaactgggtggagcccactgcagatcaaggaggcctgcctgcctctgtagactccacttctgggggcagggcatagttgaacaaaaggcagcagaaacttctgcagacttaaacttccctgtctgacagctttgaagagagtagtggttctcccagcatggagtttgagatctgagaatggatagactgcctccttaagtgggtctctgacccccgagtagcctaactaggagacacctcccagtaggggccaactgacacctcatacagccgggtgcccctctgagtcgaaacttccagaggaaagatcaggcagcaacatctgctgttctgcaatatttgctgttcttcagcctctgctggtgatacccaggcaaacaggttgtggagtggacctccagcaaactccaacagaccagcacctgagggtcctgactgttagaaagaaaagtaacaaacagaaaggacacccacaccaaaaccctatctgtatgtcaccatcatcaaagaccaaaggtagataaaaccacaaagatgggaagaagccagagcaggaaagctgaaaattctaaaaatcagagcgcctcttctcctccaaaggaacgcagctccttgccagcaatgggacaaagctggatggagaatgactttgatgagtttagagaagaacgcttcagaggatcggtaataacaaacttctctgagctaaaggaggatgttagaactcatcgcaaagaagctaaaaaccttgaaaaaagattaaacgaatggctaactagaataaacagtgtagagaagtccttaaatgacctgatgaagctgaaaaccacggcatgagaactatgtgacgcatgtgcaagcttcagtagccaattcaatcaagtggaagaaagggtaccagtgattgaagatcaaatgaatgaaatgaagcaagaagagaagtttagggaaaaaagagtaaacagaaatgaacaaagcttccaagaaatatgggactatgtgaaaagaccaaatctacgtctgactggtgtacctgaaaatgacagggagaatggaaccaagttggaaaacacttctggatattatccaggagaacttccccaaactaatgaggcaggccaacattcaacttcaggaaatacagagaatgctacaaagatactcctcaagaagagcaactccaagatacataattgtcagattcaccaaagttgaaatgaaggaaaaaatgttaagggcagccagagagaaaggtcgggttacccacaaagggaagcccatgagactaacagcagatctctcgacagaaactctacaagccagaagggagtgggggccagtattcaacattctaaagaaaagaattttcaacccagaatttcatatccagccaaactaagcttcataagtgaaggagaaataaaatcctttacagacaaagaaatgctgagagactttgtcaccaccaggcctgccttacaagagctcctgaaggaagcgctaaacatggaaaggaacaaccagtaccagccactgcaaaaatatgccaaattgtaaagaccatcaatgctaggaagaaactgcatcaactaatgagcaaaataaccagctaacatcataatgacagaatcaaattcacacataacaatattaaccttaaatgtagatgggctaagtgctccaattaaaagacacagactggcaaattggataaagagtcaagacccatcagtgtgctgtattcaggagacccacctcacatgcagagacacacataggctcaaaataaagggatggaggaagatctaccaagcaaatggaaaacaaaaaaaagcaggggttgcaatcttagtctctgataaaactgactttaaaccaaaaaagattgaaagagacaaagaaggccattaataatggtaaagggatcaattcaacaagaagagctaactatcctaaatatatatgcacccaatacaggagcacacagattcataaaacaagtccttagatacatacaacgagacttagactcccacacaataattatgggagattttaacaccccactgtcaacattagacagatcaatgagacagaaagttaacaaggatatccaggaattgaactcagctctgcaccaagcagacctaatagacatctacagaactctccaccccagatcaaaagaatacacattcttctcagtgccacatcacacttattccaaaattgatcacacagtttgaagtaaagcactcctcattagaatcaaactagaactcaggattaagaaactcactccaaactaaacaactacgtggagactgaacaacctgctcctgaatgactactgagcacataacaaaatgaaggcagaaataaagatgttatttgaaaccaatgagaacaaagacacaacataccagaatctctgggacacatttaaagcagtgtgtgcagggaaatttatagtactaagtgcccacaagagaaagcaggaaaaatctaaaattgacaccctaacatcacaattaaaagaactagaaaagcacgagcaaacacattcaaaagctagcagaaggcaagaaataaccaagatcagagcagaaatgaaggtgatagagacacaaaaaacccttcaaaaaatcaatgaatccaggagctggctttttgaaaagatcaacaaaattgatagactgctagcaagactgctagcaaggctaataaagaagaaaagagagaagaatcaaatagatgcaataaaaaatgataatggggatatcattgatctcacagaaatgcaaactatgatcagagaatactacaaacatctccacgcaaataaactagaatatctagcagaaatggataaactcctggacacatataccctcccaagacttaaccaagaagaagttgaatccctgaatagaccaataacaggttctgaaattcaggcaataattaatagcctaccaaccaaaaaaagtccaggaccagatggattcacagccaaattctaccagaggtacaaagaggatctggtaccattccttctgaaactattccaatcaacagaaaaagagggaatcctccctaattcattttttgaggccaacatcatcctgataccaaagcctggcacagacacaacaaaaaaagagaattttagaccaatatctctgatgaatatcgatgcaaaaatcctcaataaaatactgggaacccgaatccagcagcacatcaaaaagcttatccaccaggatcaagttggcttcatccctgggatgcaaggctggttcaacatacacaaatcaataaacataatccatcgtataaacggaactaaagacaaaaaacacgtttatctcaatagatgcagaaaaggcctttgacaaaattcaacagcccttcatgctaaaaactctcaataaactaggtattgatgggacgtatctcaaaataataagagctatgtatgacaaagccacagccagtatcatactgaatgcgcaaaaacttgaagcattccctttgaaaactggcacaaggcagctatgccctctctcaccactcctattcaacatattgttggaagttctggccagggcaatcaggcaagagaaagaaataaagggtattcaattaggaaaagaggaagtcaaattgtccctgtttgcagatgtaaaatacctaggattccaacttgcaagagatgttaaggacctattcaaggagaactacaaaccactgctcaacgaaataaaagaggacacaaacaaattgaagaacatttcatgctcatggataggaagaatcaatattgtgaaaatggccatactacccaaggtaatttatagattcaatggcatcaccatcaagctaccaatgcctttcttcacagaattggaaaaaactactttaaagttcatatggaaccaaaaagagcccgcattgccaagacaatcctaagcctaaagaacaaagctggatgcatcacgctacctgacttcaaactatactgcaaggctacagtaaccaaaacagcatggtactggtaccaaaacagagatatagaccaatggaacacaatagagccctcagaaataataccacacatctacaaccatctgatctttgacaaacctgacaaaaacgagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaagcaataccattcaggacataggcatgggcaagggcttcatgactaaaacaccaaaagcaatggcaacaaaagacaaaattgacaaataggatctaattaaactaaagagcttctgcacagcaaaataaactaccatcagagtgaacaggcaagctacagaatgggagaaaatttatacaatctacccatctgacaaagggctaatatccagaatctacaaagaacaaatttacaagaaaaaatcaaacaaccccatcaaaaagtgggcaaaggatatgaacagacacttctcaaaagaagacgtttatgcagccaacagacacatgaaaaaatgctcatcatcactggccatgagagaaatgcaaatcaaaaccacaatgagataccatctcacaccagttagaatggtgatcattaaaaagtcaggaaacaacaggtgctgtagaggatgtggagaaataggaatgcttttacactattggtgggactgtaaactagttcaaccattgtggaagacagtgtggtgattcctcaaggatctagaactagaaataccatttgacccagcaatcccattactgggtatatacccaaagtattataaatcatgctgctataaagacacatgctcacacatgtttattgcaccactattcacaatagcaaagacttggaaccaatccaaatgtccatcagtgatagactgaattaagaaaatgtggcacatatacaccatggaatcctatgcagccataaaaaaggatgagttcatgtcctttgaagggacatggatgaagctggaaaccatcgttctcagcaaactatcacaaggacaaaaaaccaaacaccgcatgttctcactcataggtgggaattgaacaatgagaacacttggacacagggtggggaacatcacacactggggtctgttgggggtttgggggagagaggagggataacattgtgagatatacctgatgtaaatgaccagttaacgggtgcagcacaccaacatggcacatttacacatacgtaacaaacctgcacgttgtgcacatgtaccctagaacttaaagtataataataaaaaaattaaaaataaaaataacattaaagcaattgaatgtacataataatcagtgacaattttctagtataaaattttctttgttacattcttcatcagttctcaaaatatcatctaaaaggaaagggtgagccagacgaggtggctcacacctgtaatccgagcattttgggaggttgaggtgggaggatcacctgaggtcaggagttcaagaccagcctggccaacatggtgaaactccgtctctactaaaaatacaaaaataaaaatacaaaaccccatctctactagaaatatcacattatatatatctatatatatctatctatatctatatctatatatctatatatatctatatatatctatatatatctatatctatatatctatatctatatctatctatatctatctatctatctatatatatatatatatcagggcgtggtgacagacgcctgtaatcctggctactcgggaagctaaggtaggagaatctcttgaactggggacggggaggtagcagtgacctgaaatcttgccactgcactccatactgggtaaaaaaaaagaaaaaaaaagaaaaagaaaggttgttttaagtgtgtttgtaaggaagagggcagacaaaagaaagagatcattcaagatttacacaagattgtttttatttaggaatgcctttcttttgaaggtttataattggcgtttggttgagtttagtaagtgttccagacccagctctcttcagactgatggttcggaatccatctcagcctcatctccttttaccccagcctgtgacaagaagtgctttctctgaaaataaaaatcagtacacacagttctgttgatattatatttgcttctttgtcatatgtttaggtagaattagtggtaagttttctgagttttctcagtgtttaaaaaattcttccttaaaattggtgagtcaacatttatttccagttggactttgcagacatgttataggtgtataccttgaataactttctctttttaaggtttgctttctttcacgataaatgcagtaacatttgccctattaaatatgttctaagacttcattaaacacacactaaaaaacagaatcttaagtataggcattttctgctcatgtatcactcatctacttactccaagaaaagttgatcctgaagagatgaattactgttttttttgttttttctttttaaagttatttagggaaggcagtgtgtatttaggtaggtatgtacctatgtggttatttggttgttactatgttatggaccagccttctgtgataaattgtagagtttattttgttacgttgttgcagcaacttccttgacattattagaggggcagatttccatttcctgaacagcaacttaataacaactcttgatgaacttgaataccatcagtaggtctattctcagtttccttctcatttggctaaagaagtggtctcttccctgctttattgcataggcatgaacattgagttattttttcattgctttggacattgattctttctaatgacttccagtaggctacctttcagatcattcttctttatagttttacaaaatgcgtcatacattttaaacgcatcttccgtttctctatgtttcataaaaagacaatttgtgtttagatctcatctttctgggagttctttgaggcttatattcctaatctttcaggtgggaccagtcttcaggaagttattcggagtttgaaaagataagcagtttatgtgaagtgtgtgtgtgaaacaaccctaagttaaagcctaaagtaatctacaaaatagtatttttgtctctttgtatatatttctgtgaacattcacagtttggaattaaaatacggtgcccttacgaactataatctatgacaattatctttaaacgtccaagctgtgaagcagtagaaaaatctactgtgatttgggtaaacttttcttttcttaactttctttgttatcttggaaaaacataacatattactaatatatttttttaaaaatttgtcaatgttcagtaaagtacagaaggcacgcttttaaaataaaatgcttaatgtttaattcagcacaactaaaaaagaaaccaaagttttcttaattaaaattagttatgataattgtattatgaatcagcaatattcccaaaaggtggcatgcttgaaacgtggaatatgtttgctaccaaacagtcttaaaatctacaaagaaaagaggaatattattgaaagactcttatgacaattgtcttttttgaaacatttgtgcacattctaaaacaggttataaaagttatccaagtgtgatgctcttgattattaaaagctaaacatttcaagtcagtctgtcaattagtatttttgactgaataattgaaatctttttcagtaatgtttaaattgcactatggcttttccagattttatatgtatctaaatctgtatctatctgtatgtcttcaattaaaatccccactttattatgtcacaaaaatgaattaatgttggaaatatttgtgaatacataaaaactttatgtgagatagatacagcataaaacaaaagttagcaggttataatatacaaaaataaaatattttctttttggacctagcagcatcatttgtgtaatgcataatgataaaagatgcattaggtcatgatagttcccaacatgtattttaatggtatatcaacccttcttttccttgcagtatcatagtaatcacttgtgtgtatttgcatgttcaattttacaaaatcaaaacaatgtgtacctaatacctaatgtttaaaataattataaattataggtttattttgttactttgttgcagcaacttagcaacttccttggctcacattcccccacccctgtttttttggtggtggtgttcttgcttttgttttgagatggagtttcactcttgttgcccaggctggagtgcagtgggatggtcttggctcactgcaacctctgcctcttgtgttcaggcgattctcctgcctcagtctcccaagtagctgggattacaggcacccaccaccatgcctgggtacttttgtatttttagtagagatggggtttcaccattttggtcaggctggtctcaaattcctgacctcaggtgacctgcccatcttggcatcccaaagtgctgggattacaggcgtgagccaccacacctggccatatttcccccatttttaatcaatccattgctaagcatccaatggactgtactccaaaaagctaatttgttttgaaattggaatttgttttctatagactcagcagtaataacattgggtaaggtttcatactaacttcatgaacttacttaaatgataatgcaaatgaaatacacttaaaaattttctaatgtagcaatatacacggttgcatactagttattaatcactattcactagaaaataaacttggaaattaatgaacatttaagctatttttaaaaaacttactatgaatacttaaatccagccaaaaccccttggattgttaactctgtttaccttaaataagatcagaatcgagttagaagtggtcagacacagtggagcaaatctttctgtagaagaagaaacagaaggtttagaagatagcgggaaataatgcttgagcacccaagggctctgaaggcataagccaggtagtgaaagctcaaatctggtccaagagctgtgaaatggtaagaaattaaaaaagaagtccgaaaccacatgtgagtaacgtgaaagacatggaatgaagcaggcttcccacctgacatgtagggggaaggaatcaggcactttggagaatttcttcccagacatgaagctggggaattttaattgatagtgacaactgggcgcatagcagttgctctgtaaactcaaagagaaagaactttgtagaagtcttactaccaaccaacaagtacttttcctctttcttcaacagaccctgtaaccaaaccacaaatccataaatcatacaggtgaattcccatagctctagtatgaattacttatacattaaacattttacagataaatgacactcattgttggtcatataaatattacagtggacccatgttaagctattgtggaaacacagaagaagagactcaaatcaaattggagagaatatgaaagactttcagatggccacaatacttcagctgaaagttgaagagaataattttgttaatggcattgcagctgttgtgtgctgaggtattaatgagcccctacattggctcaggtgagaaatattataggattgatatgtagcagaaaggatgaagaggacataaactcaaaagttatttaagaatctaaaaatgtgtggttcagatgaaaaggagtttagaatgatgctttgatcttcttctagtacaactatatctttgttgttgcttttcaaagatacaaggaatacttgaggaggtgtatgtttgaggagaaagatactgaatttttgtttggacacagcaaatttgagttgatcattgcattagggttctccagaggaacagaactaatagtatagatgtatatatgaaggagagtctattgaatattgactcacacgatcacaaggtgaagtctcacaataggccatctgtaagctgagaggcaaggaagcaattacaagtcccaaagcctcaaaagtagggaagccgacagtgcagccttcagtctgtggctgaaggcccgagattcccctggcaaaccactggtgtttcagtccaagagttgaaaagctgaagaacttgacaggagactgatgtttgagggcaggaagaatgcagtatggggagaaaaatgaaggctggaagagtcagcaagtcagctccttccaccttcttctgtctgctttattttggctgtgctggcagctaattacatggtgcccacccagattgagggtgggtctgcctattccagtccactgacttaaatcttaatctcctttggcaacagacacacccaggaacaatactttgccttcttcaatccaatcatgttgacactcaatattaaccatcacagtcatgtattatacatgaaggaaaatttaatataatattggaaatgtatgctcatacattccctatcctatagataatgtaaggactcaatattaaccatcacagtcatgtattatatatgaaggaaaattttatatcatattggaagtgtatgctcatacattccctatcctacagataatgtaaggacagagactcccgttattttttctatatgttgaaagagatcttcccaaccctgcccctgtatgtaccatccttagatttctctaccacagattgtagccagtctgtttttctccagttgttcagtccaagaatatgaggtcttatttgactcttctctcctgctcacatttacttgaaagtcctgttaatgctacctaacattacatctggatttcaaacacttctctgtgcatccactttctcactcctttcaattcattatcatttcaaacctgaaatattgcaatgacctacccaatggtttaccagcttctagcttttacccaagaactattttcaatgtggcaaccagaatgaccccttaagtaaaagtcaaattatatcacttctctgctcaaaaccctgaaatggctgtccatttcactcaggatacaaaccaatgtctttaaagtgacttacacaaaatgcctacattacctcttccctcataacctactattctccctcctgctcactcagctccagccgcagtggcctttttccaggctttcgtacatactgtcatatttgaacctcaggacctttgcactggctgtttcatcttccaaatatcctcattagcagcacctttgccactttctgctatcagttcaattatcactttctacgctctgttcaactattctatttagaaatgcaatccaaccaagcacttttctcttctccacattttcttttccagatagaattctaacttacccaatttatttgtacatttttcctactgtctctgctattagaatgtaagccacatattagggatatttatctcttttttccacagaggtatgtcaagaatctaaagtagtacctgacatatagtaagtgcttgataaatatttttacagctttaggagataaaattgagaaatgaaaaatgtctatattgaaggcataatgtgatgatttgatgcaaatatacattgtgaaattattaccacaatcaagctaacacattggttatctcacgtagttaccttattttttgtgatgagaacacttaagatctattctcttagcaaatttcaagtatacagtatagtataattaactataggcaccatgttgtacatttgattctcagaacttattcatcttaaaacatttctccatttcccatacctctgatcccctgacaaccacccttcttctgttgctgtgatatgatttttttttttagatttcacgtatcagtgaaatcacatagtatttgtctttccatgtctggtttattttatttaacataatatattccaggttcatccatgttgttgcaaatggcaagatttccttatcttttaaggttgaataatattttattatatatatcattgtttctttattcatttattcgtggataggtacctagtttgttttccatatcttagctactgtgaataacgctgcaatgaatgtagcaatgcaggtatcacttcaagatattgatttcatttgccttggatatatacccaaaagtgggattgctggatctagacttcctttcttttctttttttttttttttttggagtggggtggtctcactctgttgcgcaggctgaggctggagtgcagtggtgccatctcggctcactgcaacctctgcctcctgggttcaagcaattctcatgccacagccttccaagtagctgggattacaggtgtgcaccaccacacccagctaatttttgtatttttagtagaatggggtttcaccgtgttggccaggctggtctcaaactcctgacctcaggtgatctgcttgccttagcctctcaaagtgctaggattacaggcattagtgaccgtgccaggcacaatagttctagatttctgatgaaactttgcagtgttttccataatggctgtaccaacttacattccaaccgaagggcacaagggttcccttttcttcacatgcttgccaacatttgttattactcatctttttgatagttgataaatacttgttgtattaaaaattagatgttgaatatcactagttttttttttacaggtgcaagccactgcacctcaccactaatatttttaaatatggtttttgtggtcatatgttaacatagaaaatatgaaaatattaagaaaactaatttttaaaaaattgaagaagaatatgattaggttgagttaaatatgaatggcttttagagctatgcaaacaattaaaactaactgacaagagagaatttgtaaagagattaagagtgattcataagtgctgggtatggtggctcacacctgtaatcctggcactttgggaggccgaggcaggcggatcacgaggtcaggagttctggaccagcctggccaacatagtgaaaccctgtttctactaaaactacaaaaaattagccagacatagtgttggctgcgtgtaatcccagctactcaggaggctcagggaggagaatcgcatgaacctggggggcggaggttacagtgagccgagattgcgccattgcacaccagcctaggcaacagagcgagactccgtctaaaaataaataaataaataaataaataagagttattcatatgtgtggatattcacctagcaagggaacagctttctggattttttgtgtgtttgttttttcattatattctgctatactgagtagagttttccattaaaatttttcctgattattatcaatggacaatcaccaatccttcttagctttaaataacctctctaggcaaacaagaactaagtagaaaaaaatatatttgagacaaaacaatattttatagtatagttaggtaattattgcgtttggtagtttttgcaaatttaattgtatttctttgagcctatttctttgatattcgttatttagaggtgctgaaagagggaagcaccaaaatgaatcacatatgacaagtatacatacaagcaggtttaaaaaaaaccagcaaaatattttaaatagctaaataattttctatttgtcatattttaaatctcacttaattataatcattataggttcaaggtttgttttaatcaactcaagtaatattttctggaaagctatgagcaagtgttttatgaattctaactctttggtatcaaaaacacaaattggcctgtttcgtttttcatcatgcatcaacaccagtttgggaattttctttggccaaaatttctattaatatgtaaaagaaaagatgtgttttcttaaatgctctggaaatagtatcataaaacatatataatgtgtaaatttaataaacttttaaaaatattgaaatgaacatcatatatttttgaatgatgtgttgatatcttaaatagtgctacagaggtaacaaagtttaaattaattaaaattatattcaccttgaatatggaatctatttcatgtcattaattcagctaaaaattagaaactaaataaattatattattgaaatttaaaacattgtagaaatttcaaaaaatgacaaatttgctttgtacctttatttcttctacaaattcttaaaaaatgctcttagtattttttttttttttttttttttttgcttatgatttaaaatatgatatttactttggaagtttcttcttttttttgttaccagttcgtgttatttcttgggttttctttttcacctaccatccttgtatttcttacaatttgcttctgaaaatacctatttcttctttttaaccaaatagctcaaggctgggataggatgcctcccaggaaacatctggcaatatttggagaaatgttttgttgtcacaattctggggagaggaatgctactgacatctagtgggtggaggccagggatactgctaaatatcctactgtgtacatgaccacccccaaagcacagaattttccagcccagcatatcaatagtaccaaggttgagaaattcttattgaaacatacactgcgcagccaccttagtggtccagatttctctacattccaaaaattttattgaatttattctcctttttgaccacaaaattcctgatttttctctcctctttcttgttttcatttctcagattaatgattctgactatgatgtgattgaggggcattgcctttggaaccattcagttaccaccacactagatcttcaataattaattaagttctgatcattacgtgttttcatttctgtgtggataactggaggaatcttgtaattaattagcaaccatgtgtagtacagtgttaacacttgctagaaatgagtgggctctttcagaattctcagtttaagaactcttccttagtgtttttcaacgcattttgtttggaatacagacatgcaagatattctgcaggggaagatcatggtctgatagatctggaaaatgctgactttttggtcccaagaagctctgtgatatttaccaatgaacctgagaggtcctgaagtactaaagcctgcttagtttggttttctgcagctgtgtgtgtgttttttttctaataaaattgttttgtttcgttttaatcccttaaaattcctattaacatcaggaaatattgatataatcctatctgctttcacaagattctaaatgttcaaatctcctcaccagaacaagtagaagtaaatctgctcaaaggatttttaaaaaaaactggcatttttagtgaattacgtgcagagaactttatatttagttttaattttgttcagttaccttaagccttttttatcttattatacattattagagtaaatttacatttttatctaatctcatattaaggattgaataatacactttttgaagtttacaatagtgtacatattatatgtatcttgttttaattttctccaggtgtttttaataattgaattttccagtttgtttgctgtaaacattgaccatttagaaaataaattgatgtaacactatctgcttcctcaaataatccccctcacctccccccacaacacacacacttatatcttgcttgtgtagtttatagcatagtaaatatacatgcgtattttagggtataaggctaaattcaaatctgtgatgctatatgccatatgtttcctgacctatttgacaaatttaattgccccttaaagtttctattgcttctgtaatgttataacttattttttgtaatagttggtatatttattttctttacagaacaataatttccatgagaactaggactctaaaaattgctcagtactgtatggtatgtcatatagagatcctgacagaatgccgtacatgcaaatatactcagcatgtgttagttgaaaacagatgatgagactcctaacttgtagtagcatgtaatctatatgtggataaaagtgtgctcaagcagtagctattaccaatgcacagctctgaatgactaaatatctcaatcaagaatatcgacaataaatccaggagctgtggctcaagcctgaaatctcaatgcctagggaagctgaggtgggaggatcatttgaagttaggagttcaagaccagcctggccaacagtgataccctatctctacaaaaaacaaaaataataaccagagatggttgtgcacatttgtagtcccagctattcaggaagctaaagcaggaggattgcgttgagcccaggggaggacgcagtgagctataatcctgccattgcactgtagcctgggtgacagactaagatgctgtctcaaaaaaaaaaaggaaagaaaaaaaagaaaaaaaacccaacataacaacagaataccgaatacccataataagaaatgtaagattctccatgaactccacatttttgggcttagtaacttgactcttaccacctaaattcaactcatttaaaactataggccaggagcagtggccacacctggctaatttttgtacttttagtagaaacagggttttgccatattggccagagtggtcttgaactcctgatctcaagtgatccgcccacctcggcctcccaaaatgttgggattgccagcatgagccaatgcacacagcctatagttttaaatgaattttgctgattctactataggctgggcgtggtggctcacacctgtaatcccagcactttgggaggctgaggctggcggatcacctgaggttggaagttcaagaccagcctggccaatatggcgaaaccccatccatctctactaagaacacagaaattagctgggtttggtggtgggcagctgaaatcccagctactcgggaggctgaggcaggaagaatcgccttaacctgggaggcggaggttgcagtgagccgagatcactccactgcactccagcccaggcggcagagcgagactcatctcaaacaaacaaacaaaaactataaagaaagcacccagaggaggaaataatcaataaattacatatttcctggacaaataatacttcatagatgcccccaactttcccattcattgctaaaatctcatcataaggttgtaaatccaggattacatggagcacaagtttcacagatgttgtttgactcattcattcattccttattcattcaatatgaatttattatattttaggtaccaagctatcggctgaaaccagctgttagaggatggagagtatccagattgttaaggaagaaatgggtagatcatctggtcagtagtaataatggtaatggatccccagaggcagagtcaccttggggaatataaaatgcattttaatttgaatcgataaggaggctgatattgtgaatcattaaaaaataaatttgaaaaatgtaaagtagtgacagaagcacatggtcaccaggcaagaaggctaagaggcagttttgaagccactgcaaggtattctttgaggaagtgaaggatgaaagctctgtgtttaggtttctggttctaatacatcctttaacaaggccatattgtaagagaatggttaaggtggggctgttcagttggagtgaaattgaccgttaatgatccatctcagtatgatgggcaaagatgtattacatgaacctggtatcagaagagtgtaatctttgtagctctcacctatgattacatgattgccattaattttagaatctacgtggaatcttaatgattgtgaatgactgaaaaccattaagaaaactttagagactttctggataaaatgcaatgactaagttattattcgatttatatgaataaatatattcttagtctttatgtgcttttcggtttccatatgcacaccctttagttctaagtttggattttcctctataatattacaattgctatttctttgtctgtctctctcttccctcctcactccattctttccagtatccttgtctatttttctttctttctctcttctttttctattgttgcatcactggccataaccctattgcagttgtgaaatatttagtggcctcagcttatgtccctagtgggagctatggaaagtacagaaaaatgaaaagtgactcacgttattctagtgtgtctctcactttccacagctacagttattgctacccttggggaaatttacatacactataaatagaaatatatactttagaaagacatttaaacttcttcttttacatgtcagaataaacaaaagtactagtaaagaaattatttctgcactaaataatgaattgatcctcataatgccctgtaggtatggcatattgagggacaaaaattataagtctgatttcaaacttctaagtgttgaagactcatgtttgataatttgataattgggggaaaaacagagcaaataattccctttttgtctatggatcatattgcctctcagttcctttagaaaaatacaagttaattaagcttagggactggaggcgtaaaggatagtaaaaggaagaaaaataatttagctttcagaagatcaagagtactaggggaagtgattttggctctcattttttattgaaataaaaattgacagagaatttggacatcctttggaaagccaggcaaaggaaattcagtttatcataaacaggataaaaatcagaatatccaattccctgggaatcagaaattctccatgaagctgaattctgcttcagttcatctctgactcattttgtcattcaaatatgtgggatacctactatgcaccaagcattgttttagctgccggagattcaatagaaatgatacggctaagttcctggcctccgtgaacccgacattctgatgtgactgctttattattagataatgtgtaagcaaatttgccattgtgtgttctaaattaagtaaattggatttaaaaaatttagaaagactatcttttggtattcttacaacttactatttaaaataatacaccatttgaaagaaggttttgtgcctctagctatagccacaagtggcttcatgccttcagaaggggtcagggaagacaagcagccaggaggcagtagggacagaatagttgctttgaatagagacaggtttagtccagttttgcctgagagggttagagatccattctgctctctgtccttgccatggattctgttgtctttcactccagccccttctgctcaacatgcatcattctttgtttccactctgcagtcctttcatgctgcttacttaggtgttgtaaattttgaatgactctaatgtctacagcatttcctgaattttacatctggacagtattgaagggcagcggggcctcccaaagagcctgttttgcttgactaagttcttttgctgtattgatttagtataagaaattctgggataatgttcaatttcttcatggttcttaaaaatttcaggcatcaacaaaggctgtgtattccaggcaagagatacaatatgaagaaaaaaaacaacaacagactattatcagcttgttcaaacacaaatctctacaggttgacattttcttaggattggttcccagaatgtgatgtattttcttctgtgggtgttcaactcatttgctcttacaactgaaaaaaacagcagtaaaagccaaattgaaccagtccagctgttatactattacttttaaagaatgcctcaaattcttagtgtttacttctagtttagttcgtaccggatttctcttcacatgtcaagctatgaaaaaacaagctgacaaatcaaaaggttgacttcccaatgtcttctgataaaaataatatttgaactattctatctgtaacacaagaatatgtatttatatgtaagaaatcctttggctcttccctcttttgttatttacaatattgggtgcattctcatgatctttctttgctattcattttatttatttttactttcctacatagagagttcttattgtttctgttgtttcataaattttagaagcctccaattttagaactaaaagaaccatattgtagagatttcatgatcgccaagtttaatccttcctcttacctatgagaatgcctgtaggttgcttgtattttattttatttcataaactactggaacatattctttatttttatttttatttttttattttttgagacggagtctcgttctgtcacccaggctagagtgtagtgacgtgatctcggctcactgcaagctccacctcctgggttctcgccattctcctgcctcagcctcctgagtagctgggactacaggcacctgccaccatgcccggctaattttttgtatttttagtagagacggagtttcaccgtgttagccaggatgctttcaatctaccgacctcgtgatccgcctgccttggcctcccaaagttctgggattacaggcgtgagctactgcacccggcctggaacatattctttatgtgcttgtatttcttttctgttaatatttagatctatagtttatttgcagctactgtaaattttgatacatcagatttatcgaacatgctacaaagagtaaattatgtcatagtttgctattttctcatttagatattactccatacaatacagaacataagctttgggcatgtttgattagtaatttaagaatcctttctatctatacaagtagtgacctacgcatcctccatttggcctccagtgtgcaattctgtgtgattaacattttaaaatttcctatttttttaatgctaacttttgtaatcttcaggtgtcagacgtttagatgaaaacagtacatctgctaaattattgctcaaaatattacatattttatgcaaaattgaatggttcacctacaggtagaatgaagagaaacaaacaggcaaaattattctttcagttctgttcttatcatcatacagttgggtctgcttattactaaggttagatcaaaggcctgagataatttagctagtttcctatctagataaacctagacttggtctaaagccacctagcagctctgtgacttgctatgatttagggctgctgttatctcccaaatactggttgtaaattaatgaatgaatccagaagttaaagataactgagacttttacaacatgaagattttcctgactgaaataaaccaggtcatgtgtcactcatttatattttaaattggtttaattagtctgctcctctgtgatcacctagtgaacataagctcttttggggaaacagaagttttgagagagaaggagatgaggggatagtaagaaagggatggttttggagtggataatgaaagctatgatcagatgaaagtgttgcagatgggaacatggccgttctggacagggtatcgccatggatgacttaataacttgggacatggggtaaataaaaatagaaccgtaaggaatacttggggagggggtgtaattgaccctaaaataattgtggaaagccaagactatctgatattttttgatatcaaagaaatataacctagaaagtcagaaaaaaactttagcatttagttcactaaaagaaataatgatccaaactaattgatatgcctgccttaaacacagttttctatgaattttaggctcatatacccttataggaaaaacatgatcacacacacacaaatagcatgtttttcgagaattattaaatattgggaacctgaaggtatcctagagatcctaagatccaaactcttcatttagtaagtgaagtaaacaagtcccagaagattaagtgaattggccaggtcatagagcccatcttcatgcaggattttatagtctgaagtgatatttcaaaattgggggataaatgcttcagacctttcaaaatttaattattgtagaatatagattagtgactaaaatgaaaagaaaaagtttcaggaagataatctctattattttggtataaatgttgacgaagaagagataaaaaatatttttatggcaacggcttgttggatacgttgccgaattttctttaaacaatatgaaatgatttttagtaggaaagtgtcagtgctgtatgtgtgtgtgtatatgttacactttctccgccacttccaagccattcacagttaaacaggatttcactcaaacattgtaacagcagttgccaaagcactaaactctgtatgtttttggatgtcttggtacaaagaataagtaacaggagaaacaccctcagggaaagtttagaaactctgtgtagcttttttcactttaataattacaacagtgttaattcacagcctctttgactagacacttaggatttaagtagcctagcaattctgccttcagctactagtgagttcttttgcatatttatcagatgtgcccgcctttctttttatttcatttttttctttttttctttccttttctcttcctttccttttctttcttcctttctttatccttcatttttctttcttttccttccttttaatttattttttaaagttgttaaactttaagataaaatcaatggggcatatatccattctctatcaaaatagatctgccttataaatatgtttcatttaaaagtcgataaatttttaaattcccagtattaatgtgtgattattttatttgcattatctctttttttaacctagtatattaaaatgtatgtattcaacacacagctgctgaggagctctctcccaccttcattcttcctcaatcaacagccctctctatactaggcactgttgtaggaagtaatgattgttgtagcctccatttattcttcataccaaatactaaattatttaggttcaatttgccgtaatgtaatcttcaccacagtctttgaagttgtatatcattgtcctcactttatgtattaaacaaaattttaaaaaatgttcaaagaagttaatatcaccaaggtcagtaaccagtaagtaagtttgtcgtggttcaaaaccagttcatctgaagttcagagtcgggtgtatgtgctgtgccttgtagactgtgtttgaacacaaaagcaggaggagggatatcatatgctactggttttcttccttctactctgcctactatcttctttcttggctccacttttcccagggcatagtctataaatttctgagaaacattttgcacttctgttatgagtaggaactctttcatgacttcaacgttgcatttgaatgcatatgcttctgcaaaatgtaccatcatcaagttactttaagcactttgggggaacaacatgatgactatacccaactttgccaacatacccatgatatgcatgattcactttcattattttagtataaatgatgccaaaataaatagaataaggaggttaggatttaggagagttgggtgtttcagctctgccactaaacatctctgatatttgggactaatatcttaatatttattggctttagctttcttatcagtaacagaaaaaaagttctagatgtgtttagggtaacatgccatgataaatttttattattatttctaataagagtagcacaaggcttagcatatagtaacatttgcaaatcttaagtgtctaaatcaatgcggttttacatatccttccataaccgtgccacttgataatacatttttttctcatgccatccaataactttttttctctaaaaataggactaggatagtaactgcagaataactaaagacttcacttttttactgctcagatgaacattcaaaataagtattatatggaattttgctgtagttttatgcttacttggcaacacaagcctggccttgtttctgtaactcaaggtttttgaccatgaatggaagttaaattttataatcagagcattttctaagtcttgtcccacaaaaaaataaaatataataaaatggaaactgttcaggccctagagagaatttgctggtcaagcacatatttacacaagtagagtgcatggcactcttgatattgtttctttttcaggagctgatttaatatcctgccttatgttgatgtgcaggctcattggtcatgtaggttagcttagagcttatattcccattcttattatttctggaatatattttaatgtccaggttatgttgaaacttattctaataataaaaatagctgcaatacagagtctccagtgctcacagaaataatgtagaaacaatactttatttaataaaaaagaaaaagaaaattttaaatctaaaatatttagtatcttcttccctgaaagcaaactggagaggaaatatgaatgagaataactgtgtacttgtgtgagaaaaagattctagagacaagagaatctttttgtttgtttgtttgattttgtctaggtaggatacttcactagtccaataatctttcctctaatgtttaacaacattcccacagtaacactcctgaaaatggctatgcaattgggaagctcaaaaatttgtaggagacatgtacatattatctgtacatattttcattcttaggaaaatagcaagtctacatataggcaagcagagaaccatttcctttctttctggttcatcacacttccccaagaatacatagaatgtgttcttccaaagcagcaaaagggatcctctcatgagttctttttttcacagcttgttacaactgcatgtttatgcatcttttcttatccatttccatcgcttcactttggatctctgcacaggattctgacaagctctttctccttctggcacagcagattaatccttttctaacacaacttttaccctttaaattattgatttgaaaatatccttcccaaatctaacttcattctgtttgacttcgtaggcactcacgtctgatccagcctcacacatcgaacttcctcactgttcccttgctaactcatgtctctctcactcttgtacctctcttgtaagatcacatttaaccacttcctaatatgctgtatctgtactccaattttctatctaggtcctgctcatctttctatgtcctattaaataccaccttttagtgagagcttctcttgtcattgttcgtatttcttgttcctttattttatacattaccatttaattctattaaaaattccttttagctaacaactacaatcacagttatcctataaatgttctcttcttggaatggtatttttggacattccatgttttgcaaaaggcttctgttttcaagatttaagcttgattctgctttactttataaatgtgtgccatgtccagtgcctctgttattacctcccaccagaggatgccaggccttgaagaaccctgcctgcatctcacaatataaggagaagaaaccagaacaattggtgtctgggattctagcaggacagatctcccacttggtcccatcagccatgggattcattagctgcagttaacccttcattggtcccaaactcttctctctgaatattgatgagaagatacctggaactttcatggccttccagcattttccccctggttttaatcaagcctttggtaatgagtttgtggcttgctctcttaatgaaccctatggtatgatgaaaactggtaccctcagtaaaaggccatccaactgtgactaaagggctcagaaacaagaggctgagtcagccagtgctgccgcagatctgctgtcagcaccatcaggagaatttatcaccacacaaataataataataataataataataataataataaatgtgtcactgcaattcctactagaaactcaactgccatcagagtgcacaaagtcccaaatttatataaggaacagctgggtcacttccatgacattcaagcttgggctggagtagcgacgttttgtctaagccaactcagaaccctttataatactcctcccacctataattttctgttttaggctctctgaaatatcctccctttctgttacctttacctgaccattacctcgaggaatctctcaaggctcacactcggaatcttttttactgcagcttgtagtccacagtagctggctctttactttgggcacagctattgatctctgcccggaagtatggacttgatcttgggacttccccctaggtctcaaggtctcccttgtgaaggctacctattttgttttccctttcttccatatgcccatgctcaactcccaagatcccagatgcagaaaagctccagctttgccccgaaccaactactcagtatgctcaaaagcaaaaatcacggactataagtatgaggaacttaggtgctgtactgaactttgcaactctcatagtatctaacagaatgaggttacatgttaagtattatttgattaatcaattgataaaatgtcttgtagataaacaaacaagaatccaaataggaccacaaaaatgaaacctgagacttccaaaataaccgaaatggcaggcagtccatgagatagtgtggaacataattgacactaaatagactccaaacaacaaaagattgtgtaatcctaaacactgaagcctactgtaagaaattataatactgtatgatgctaatatggagaattacagtagggattaattaaatgataagagctaagagaagaaacattagttaatagaatatattttaatttttatttttgtgttctgctctattctcttggtctcaggctcagctaaataccatacgtagaaggattaccaacctcttcctgaaagcttgaattacagttccccaggtggatattggtacttcatgaaggatggttggagttgctgaatattttacaaaggaaatgcgtgtggctcaaaggataatctagttatcttgatgaatttatcctttgtagttgaaagaagttttgaaacattagacttcaaagaaaagcaggaaagtgattgagcatttatgtaaatactccctaattgcaaaaaagtggttcttagacatttctaaattgagtgagataaacatcaaaagtgctacattattttctattttacaagtgtcactatctctctttccctccatattcagagatggtttttctgtatcatttctgctaaaagttaaagaaataaaaacgaacatcccatattccaaaaatcacgctcaaacatgggagatattttgaattcagaacacaggttgtccaaaaattaatattacgtccagtggtcagtttcccaggccaatccataaacattctataaaccctagactatagcttaaatctagtctaaacataacacatttgtattaaaatatgtagagtaagctatcctgtaaagattgtaagaaagaagattaaaaaacacaattgaaaaaaaaatactactttttagtgcgatggctgggaggaaagtatgtttaattagagcaaggaacagcaaaccaaactgcagactaaatcaggccacccacctattggtttatattttttccatggctctttcatcctaccatggcaaagttgagtaacttcgatagagaccatgtaactctcaaagccaagagtatttacgggttggaactttccaggaaaaaaaagaaacacacaaatgctggctctgaattgaaagaggaacaggagctagatggaactctctgtaaattttaatgttaacttctgtactgtgagctcctccaagggagcagtgctgtggctcgggcatcctctctccagagatgaggctcgtgcctggcacgtagtaagtgctttgatacagttctagtaaattccaagggcttgataaagcaattcctctagttctttctcatttcatttcagttcaaaaattacacatataattaaatattattttcagggagtgaactttttattattctttttttttttttttttgtagaacacaccgagcttctttctgtgggctaaagtaggcttcagttttctaaaccatgcatgggtatttggtgtaggtacttggaattaaaataaatattctgtctggagtatgtcctcagatataaatttttaagataaaagtcagtaattatcttattcagtaatctttccatcaggcatttttatttatgtaatgtatcataccgagagaggtgttaaaattgtttctctcaacttgtttggcaattgctgacaattattgcgtaatagatgtgtcagtgcatacagccagatttttgttaaggattgtaatcactgtcagtaaaacaaaccctctcaatcccatatcataaaatgtgtgctaaattctactctgcatattactgatattgcattcatgtttgcctatttccattttcttaattttattcagtggtgtttactgaatgcccccaataaagaatagggaattgtggctcatttttatcttacctttaccttcattcccccaaacagcagcaacaaaagcaacagaaggaaaaatgattttgtttttctgtcttctttcatgctgtacatatctttcttactgtacactttccctcaagaattatacgctttaaatttgatttgatatatgcttattcaattatacatgttacttgataactaacttttatcatagttattgaagtctacattcaataggtatgaatcataaactattcaattgaatctgtactttcttccagtttcatatcataattaaaaataacttaatcacttttatagtgtcttgcatttccttggtgtattatgtatttcaaatagactttctgttgcctttatatatgaatgacaatttggatatgaaatccttggtcacattcttttttctgcccaaatgctgtaatcttctggtatctaatattatggaagacaaatctgaaataacttgatttatttttgtattgtggatggcatgtcccttctacctggaagtttatggcatcctttatttttggaaccaataatcctttcacagaatgttttcatgtggttcattttcattaattttatgctatttacattttaagaatgcataatgcattcaaacaacttacctctattcaagaacctagtaaatattaaagctagggccagaaatcagtctcttatatcccgtttctatcctctttcttcctagttactccactagccctgcatcttaaaacactcattgcagtgtaattgtatttattcttgcagaaaaagtcttagtttagtctcaaacttagaaataattttttaaagtctagtcaggtcactagtattgttgagggaagcccacgaatggctttttcctaagggaagagtgattctgagagcaggtaattgtcactcagaatatcatcccacccaactctggtaaatgtgagtagaacatgaaagaaccctcaagcgttagcacccttgcttcagacatcttctgctctaacagaagatgggtcacagcagaggtgttacatgtgggaggtagaccacactgttggcaggcctgatggctgcttttggcaatggtagaagcaaaggaagttcacccactgagagccgaagaagagaaaatggcatgggccacaaagtagccaaggatattctactccatagcacatactatgtggaaaaattctgcagaatccacaaaactatacattatcacagaatcaaatcccataaatattgtcttgtgattctttgtgaccctgtgactttcctctttccaaatttgatatgacctggcttaagtaagatatattgttttctttttaccctctccctttttcttaccttctcccattcatatactctctctcctccccctccttccctctctttctccctctcctattcttttctctgaaaacttactaagggccatctttgtgataagaaattcaaccaacaacacggaactctctcttattcagattcaggtttattatggccacattttctgccttcctttgacaaatcatggattattatgaagcatgaaacccttcagtctgaaaactataataacaaatgtgaggtagtttttccacaacccattaatacgtttctattgctaacctgcctgttcccatgctcttgtgcatttattattaatactgtgagcagaacagttcctctgagatttggatagttttaaaactcacaattctatgcctttctctataatcgtaatattttagagtatgtattaggctatggataaattaaaacatatcacaatagaatatgtaatgaagaccttaggtgagtttatcacaaatgacaaaggaaaactatccctgaagaaaaaacaatccatattgaaacaggataagaacaaccacaaaaaattccataaggaatctgatgaacatttgagtgactgatactgaattcagcccattcttcttgatgtgagtgagatttgaaacagtacagtgagcttttccagtatagcatttttggaacgtgaattaccgtacataccactaacatagaactcaaagtatattaaggctgcaagagagcttggcagtcatttaatatcttacttttcagatggagaaactgatgcagataaaaggcagttgcacgccctaagcatttagctagttcgaggcagaacctgaactaaagccaaatgtaaagtctcttaatgccaagttttcttcactttatcgagtttccttctgtgtcctgcaacacatggcttagacaggttaatttgttctagaaaatgttagatataccttggactcatctgattctaggctattatgtcaaagtaatatgtcatttcaggtgattctcttaatatgagacataaaattattctcagcatgaaatttgaaatggtttaaaaattttgcaatcagcatacccaccaccaaccaaataataaagttcatttattttgcatcttatatcatgaatagactagagcacaccaaaccactgagttattgaacttgcatctggcagaaatcaatttgacatcccaatttggctatttctaggccatatgagtaatgtcataactgtgttacatcagtggtttttcaaatgtggctgtacattataaccacccaggtaaaattaaatcagaatctctggagggagggcctgagcttctgtttgtgataaactaattagagagttttactagtaatgatgtgttatagtaattatgaattttattacacaaaagctacttttaatcacaatactcagaaacacagattgataataaatctatttgtaatcataaagtaaaaatcaaagaatgagaaatgcttcaattttagacattttctaattctctcaggtaatgaaattcggactttgttctttgatccatactctctcaatctgtaaaatagaataacatttcttgtctcacaaaacaattacgaaaattatgttggccacatgataatatgccttacattgtgtacatagttaatgctcaattaatattatccttgatgacaatggtgatgatgatgttgattaataatacttaataatacttcagcttcaataaattaaataggtttccggtcctatgcccattcaaggcttgcatgaggattccagcttgcaatatagacatcttagtttaaattcttactaccacttatagattatttagtggaaagctaaaagtattagtagtttaagactaatggggcatcttagagaaacacagaaggtggaacaaagtctatacatatgcacaaagcagtttaaaattaaacagatttaagaatttagacattgtcaaagagaaagttaaagagtagattttctggtttgaccttttagcaagaaagtaaatgagaagagaagagataggaccatggaggtgacattttgcaggtgcgactgagtgagggcccttgaaattcaacataaatcatttgaatttcaacattcagatgtgattcttgaacacttttgctcatttaatgtaatcatttgaagccttatcacacttcaattgaaagtaacttacagctgtttatattgagagtttatcatgtagaacactcttttaacaatatgaaatactgtccaatcactctggttgccatatctaatgtttcttttgcacatgatcccataaattactttaatggaggagtaattttctcacataagtttgtgattttgtggctaatcttctgagaacatacgttcacagacactaaagacagcactctgacttataatatgtcaggtaataacggagatatacttcaaagaagcgatttccttactgacccttggtaagaacccaggaaaatgatgcaaacctcatgcgttcgtttgttaattaggagactgaacattcatttctactgccttttatatgtgcaggaaggcttctggctctggccattctgcaaaccaaggagataagcagtgacctgcagtggtgctctttccctgttctgggctttattcttctatgcaggaaccaatatcagcactgtcgttgagttgtacttcatcaacttagaaagactgttgaagtacgataaaggatgcacaaagctgttttatttcagtagaccctttttatcagtgtctgtgataattgtagcaatagcatggctctaccacatcaacaaaccatctgtgggccctttttcaccattgctctggccctttccagaaaaatgtgccacatccctgtggtaccaaaaccctttggcaggagatatcatggcttcaaaataagagtgtccaccttcgccttacaatcaggattgatgcattcagatttggtaaagaaacacataagaagcattctcaaaacttttataagtgataatggaaagtaaagcagaattgttacattcctcatgaagttcaagaggtatacatgaataccaaagtgacaaaatcctcttgctcacagcaccaatagtgacagtgaccatttaatacatgctttttttaatgaaaagaagaagacagatcccttctctctctttctaaacagacatctagtcattaagaacatgaaaaatgtcattcatgttttccctaaaaagcattttctaaaatttagtggtccaagaagtaaatgtccagtgtagcaacaaattacaacacagcaaaatttgactttaatcatatgaatctatcactcacagttgcagaggtttggctaagttcataatgtaggtattatgtgtatgtagtattctttctggtcaccaattattgggggaaccacccccaataattcaatgtaggttcttttcagatatcgggggaaccacccctgataattcaacgtaggttcttttctattttccctgagtgttggctggtctgagtaataaagggaaagagtacaaaacagacaaattttaaagctgggtgtccaggggggacatcatatgtcggcaggttctgtgatgccccctgagccgcaaaaccagcaagtttgtattagtgatttttaaaggggagggagtgtacgaatagggtgtgggtcacagagatcacatgcttcacaaggcaataaaatatcacaaggcaaatggggacagagcgagatcagaggaccgtggtgaaattaaaattgctaatgaagttttgggcacatattgtcattgataacatcttatcaggagacagggtttgagagcagacagccggtctgagtaaaatttgctaggcaggaatttcctcgtcctaataggcctgggagtgctacgggagaccagggcttatttcatcccttatcttcaaccgtatcaaccgtataagacagacactcccagagcggccattttagagacctacccctgggaatgcgttctctttctcagggctgttccttgctgagaaaaagaattcagcgatatttctcctattcacttttgtaagaagagaagtatggctctgttctgcccggctctcaggcagtcagacctaatggttatctcccttgttccctgaacattgctgttaccctgttcttttttcaaggtgcccagatttcatattgtttaaacacacatgctttacgaacaatttgtgcagttaacgcaatcatcacagggtcttgaggcaacatacatcctcagcttacgaagatgacaggattaagagattaaagtaaagacaggcataggaaatcacaagagtattgactggggaagtgataaatgtccatgaaatcttcataatttatgttcagagattgcagaaagacaggtgtaagaaattataaaagtattaatttggggaactaataaatgtccatgaaatcttcacaatttatgttcttctgccatcgcttcagccggtccctccgttcggggtccctgacttcccacaacaaccaataactttatttagtacgtttaaaatatagatttttctcttgactttagtgttcaaagcagcctgtaaatacttgtaacatggaatttttagcctgccccccaaaaaagcattctagtttcttttcacaacatactgctaaatcagaaaccctaagatattagcctgttctcatgctgctaataaagatgtacccaagattgggtaatttataaagtaaagaagtttaatgaactcacagttcagcatggacggggaggcctcataatcctggtggaaggcaaaggagaagcaaagtcacatcttacatggtggcaggcaagagagcatgtgcagaggaatcctctaacaccatcgtatctcatgcgacatattcactatcatgagaacatcatgggaaagacccacccccatgattcagttacctcacactggatccctcccatgacgtgggaattatgggagctacaattcaaggtgggtggggacacagcaaaaccatatcattctgccctctgaaatctcatgtccccacatttcaaaaccaatcatgccttcccaacagtcttgcaaagccttaacatatttcagcattaactcagaaatccatagtccaaagtctcaactgagaaagggcaagtcccttctgcctatgaatctgtaaaagtgaaaacaagttggttgcttcctagatacaatggaggcacaggcatagggtaaatacacctgttccaaatgggagaaattggccaaaaggaaggggctacatgccgcatgtgaagcaaatccaaaatccagagaggcagtcaaatcttaaagctccaaaatgatctcctttgactccatgtctcacatccaggacatgctgatgcaagagatggattcccatggtcttggacagctccacccctatggctttgcagggtacagcctctctcccagctgctttcatgggctggcattgagtgtctgcagcttttccaggcacatgctgtaagctgtcagtggttctaacattctggggtctggaggatggtggccctcttctcacagttccactaggcagtgcccctggggactctgtgtgggggctccaaccccacatttctcttctgcactgccctagcagaggttttccatgagggcccctcccctgcagcaaacttccacctggacatgcaagggtttccataaggcctctgaaatccaggtggaggtccccaaacctcagttcttgacttccgtgcattcacaggttcagtgccacatggaggctgccaagacttggggcttgcaccctctgaagccacagccgaagttgtaccttagccttttttagccatggctggagcagctggggcagagggcaccaagtccctaggctgcagagcagaagggccatgggccctgtccacaaaaccatttttacttcctaggccactgtgcctgtgatgggaggggctgccatgaaggtctccgagattccctaaagacattttccttattgtcttgctgattaacttttggctccttgttacttatgcaaatttggcaggcaacttgtatttctcctcagaaaatgggttttccttttctattgccgtgtcaggctgcaaattttccaaacttttatgctctgcttcctcttaatcactttgccaccttagaaatttcttccaatggataccctaaatcatctctctcaagttcaaagtttcacaaatctctagggcaggggcaaaatgccaccaatctatttgctaaaacataacaagagtcacctttatgccagttcccaagaagttcctcatctccatctgagaccacctcaacctggacttcattgtccatatcactatccgcattttggtcacagccattcaacgagtctctaggaagttccaaactttctcacattttcctgtcttcttctgagctctccaaactgttccaagctctgcctgttactgaattccaaagtcacttccacattttcaggtatcattacagcagcactcctctctactggtaccaatttactgtattagtctgttctcacattgctaaaaaagacatacctgagactaggtaatttataaaggaaagatgtttaatggactcacagttcagcatggctggggaagtctcacaatcatggtggaaggcaaaggagaagcaaagtcatgtcttacatggttgcaggcaagagaacgtttgcagggaaatttccctttataaaaccatcatatcttgtgagacctagtcactatcatgaaaatagcatgggaaagacctatccccgtgagtcaattacctcccaccaggtccctgtcaggacacttgggaattatgggagctacaattcaagatgatatttgggtgggaacacagccaaaccatatcaccaactgtatctaaattctaatgttaaacaagaaaattgtaaaatataggctaatctttgctttttatccatacactaatgagctttatttatgtggaaataataacaaagttattttatgctgctaaaactaacttatttgaagttcatgatattttatcctttaatgattctaaaatatgcttgcaaccacaatctgctgtcttttctgagacaatgttttctatatataagaagtagcaaaatgtagtaagaaaatgacagaactgggtctggagacctgaattctagtcctaaatacactgctggtcacttctccaatctggggtttccatttgtaaaattatattccacagatattgaaatatttaaatactaatctgtgaatgtttgtttctgaacctcactttgtcactttaaaacaaaattatgtaattattttacaataaagaatatgggagaattaattctccagctttgtcattttattctttcttctctaaaacagatgctgcaagtattaccaagtgtcttcagccttggaaagataaaacttcctttgcttgctgcagtatttatgtatacaattgattcattaaacaagggatgcatttttaagaatggcttgattttctttggaaaaaacggtttgcactaaaaacattaaatcaggtgcagtttatgtgccaatgaaccaaggaacagcagacagtaaataaagttgagaatactgcacattcaaacagaaagaaaatgagaagaggaaactgcaccagtattgaactaacatggagggcataaactaaacagtgactgacacagtttaaaattgctttcattctttctcaacacttttcactcagtggcttctttacagctttcaattaacctgctccctctgcttccaattgctctttcttactgccaatgatatttaaaagatacactaaattatagattcagaaatgtttggaaaagactctgttaatagttttgctatcctcagatggctttaaaattttgaagggtgcaaactgctaaactaagaacaatattggtgtcaggattcttggagaccagaacagtcaatcccagggtgaccagccagcccagcagatactgagatactgactgcactcctgccaatggaagaccatccaggcacaacctcctgaagccttggccctttgcctacaacgcacgcctcagaatgatgtcagcatttgaaaaggatttgtatttaccacatcatttatcattatatttgaactttttaacatgtactctggaaacatgtaagtcaaactcccttcatgaccacttccatcatgatggtgtgaatctcatgcctattataaagagatccatcatccatggcagtctactgctcctgcacctctagactggaattgacttgccatgtgagttgtcttggtctctttgtttttacaaagtttgacttctgcttccccaacctttagaatgctgtaataacaagaagtttgcatatgcatatggaatgctcatgcacaattacatttgagtgcacagtgagtaatgtggtatattaaccaacagtgcttaaccttaaaagacatttgacagagaatcacccacacttttcaatgaaattaaaatgaacagttagaaataacacttccatggaattaccttatttattttaggagcaaaatggaatgaaatgaattagagactcttacacaggcgttagttcatgtttgtcataacagcaaacagagccattggcatatgtataccaataactacaatgagaggtagaaagaaatgagcaccagccaagcacatgggagttttgagtggaggattagttacagttcagaagatcccaaaatgttttgttgattgtcatcatttaaggtaagcccaagactatagggaaaaattatatacagagagtcagagggaaaggagggagggagggagagagagagagagagaaagagagagagagaaagagaaagagagagaattgtgggacctagagataattacaggatagctgcttctagagaaaccagaagagaagacatggcatgtatagaaaactataaatagttcagcagtctagataatactaatatatttttatgtactgtcaaatataagtatatattcacatagaaagaaacatatgcataaagagacatacaccaagagttaacaggaggcttttgtattgtcgcactactattggaaatttcccagtttctttactttgtgcactcctagtactctaggaggcttcattttatttccactaatgacagtttatcttcaagttagtgtgaaagctgcaggctattatcattgaaacactgggtaatatttttgtacaaatttttttccccagtgaatttcatttatttcctcataacctctctgttttgaagatggtctctattcagtgtaggaaaatttctctactggaaaaaaaatggaaagatctgcaatattatacaggttgaaaagtttttccactttcatttttcctagtgtatgatagcataaactagcatttttttacgttgtaaaggcaagaatgatgtaaaaaccagaaaagaattaatgtacgtaagctcattgttattattcctcatagcaaataatatcacaaaagacaaaacaaaggaattatttgtaggaacttactaaagaatgtctgtttgcacaagtttaaaatttgctaagtcttctcatcaaataaatttaaacagcttactatgaagattgataggtatttaaactgaccttagaaatcaggtatataatttctgactttttggttttgtaattaagacgtgacagtgtgactgaaatttaaattcaagaaattagaccagcagctatacctttaaaagtacctgtagatttttgttccatgatactattttaaaatgtactcaaagcttgcaggtttaattacaggatcactaatttgtttccagatacaagagacttaaaatttaagtataactttaagccaatatttaatcattcaattgttcttcaaaatattaatcttctctgtatttttaaggaaaaatgacttatctagtctaacagtatgctgacttcatttcttttttccagcattaaattacatataaaccagtttttcaagctttaaaaatatggctcaaattaaaagccggtttcttgaggttttcaggtatattagcccattttcacactgctataaaaatactacctgagactggataatttataaatgaagaggtttaattgactcacagttctgcatggctgggtaggtcgcaggaaacttagaatcatggtggaaggggagggggagcaaggcatgtcttacatggcagcaggagggagagaagaggcggagctccaggcacttatcaaacaaccagatctcatgagaactcactcactatcatgagaaccgcatgggggaaatcacccccatgatccaatcacctcccaccaagtccctccctacacatgtggggatgacaattcggattataacttgagatgagatttgggtgggcacacaggcaaatcatatcatcaactatcactaatattcctgcttacaattcagaaatataccccattttggtacaatttggaaatatagggaaagtgatatattctctgagcacttttccctaaaatgtcaattataaattgaagattcagaaaatgtgttgatttttccaaagttgtgtcaaataggtagatatatgactggaacgattaactcaaaagtgaatgacttattcgttatattgaaaatagaaagcccaagtcccaaaataagagatatattctaatttctatgtatcccccaggatttgtgcctcccatttgtttaattgggtgttgctagtgaaatggcagtcttattagctttaacgtatttaaatttatgttcctgactcatgtgccttgttttcaaaccagttcaaccatctacgttatggtatcatcttacatcttctatcttaaatgttatacaaagtgtgtaagatctcaacttgtcttcatcctaagaaaaattcctgcaatgttgtcaaatttgaaatcctttttcttatattctaggtttcagtttttacagtgccaataagaagaaaaatgaccctggcatagaactttttttttttgttttatcattggtgctatatgtgaattccaaggtagtgttttgatgaggaacatgtttagtgagaataatttcattgatttcttggcatttttattagtatatattgaagatccagaaccatctattctttcaagaattatcttaatatatcaacatatactacatttccctaatctctactctgtattcatttagtcaacacaaccaaattcataatcttctttgtatctacatttgtcgattttttccaagacccctttattttccactatctccttctccaaataatgatggttgtaactgtaagttcttattcatatccacctaatcatcaagtatttctgttaattctccctttaaaacatgcctaaaaattattccatctctgttacttgttggggacacaataacctcttagagatagaatccagcaaatggagtggatgtcatttttttcttgaaatatcaatctaaattttagtagagaaatagcagatataattgtttacttgaaatcaatataatgcactaatccaagatgccagggactaagaacttgagacagttcaacaggctgagtcataggaatgggcctgtagggatgggtagaacagaagattgcacagggcaggacagaggaacaaatgagataggaaggaataagaaggaaagatagagatcaaggtgggagtacctactataacatacagagaatgaaaaataagatcagttaccacaggagttaaataattaaggttgtaattttatcactgcacatgactggaaggaaaatatcctgttttgtccctttttacttgtatacaaatgtttcagctgtaataatttactgtggccataaaaataaatgttccatttgaaaacactttacccccaccttttaaagggtgtcgacttcattcaggtcaatagagaaattagagagggtagaaggaaaaaattgaagatgtgaaaggtgatgtagaatcaatgtgacaatgtaattcatttaccttttaataaaaattacacacaacttctcattgcttttcttttcttaaagatcatgagctgaaattttaatatttctgtttctatgcttgaaaaacagtctttctcccttgcccctaccataagcagtggctagctaaaataaactaatccaaaaagtttcagttctttcctcaaaaaatcccattcaatgaagtccgaaaattagttctaaggatatctcaatttatgagtgacagcttctggtagtgtgaagaagtagaatctgtctaaaatattcacatgataactgttttctttttccaagactagagccattataagctgaaatataggtagagccaggtgcttcacaacaatgtttcagtgatggaccacttccacatacacaaggatggtctcataaaattataatactggccgggcgtggggctcacgcctgtaattccagcactttgggaggctgaggcgggcggatcacgatgtcaagagatcgaaaccatcctggcccacatggtgaaaccccatctctactaaaaatacaaaaattagctgggcatggtggtacgtgcctgtagtctcagctgctcgggaggctgaggcaggagaatcacttgaacccggaaggcggaggttgcagtgagctgagattgcaccactgcactccagcctggtgacagagcaatactccgtctaaacatatatatatatatacacacacacagacacacacacacacacacacatatatatactgtgtttttactatgctttcctttgtttctatgtttttagatacactaatgcttaccattgtgttacaattctctacagtatccaggagagtaacatgtaccaatgtatagcctaggagaaataggacatgccatatagcctaggtgtctagtagattatgccatctaggattgcgcaaatgcactctgcgatgtttatatcatggaatcccctggaggacacatttcttaaaatgcagcccatttttaagtaacacatgactctgtattccatcttctaacccttctgcttctggaaaagcacagacttcaggccaatactgagtatggcctctgaacagaaccaaaagagacgttgcagggtaaaaaggagttaatgaaaagttttttgtttgtttgtttgtagcctggataatttgggttaagataatgtttcaacaggaacagaccctgaattactgaatccaaaagggatgtcttgggttgtttctcacgagtggtcatcagatttgtatttctgcaaaatgagattttccatatttttgttagacttcagccaaaacttttgctgtgtagaaaggggaatgcaatttttcttatggtatcaatgagtgagaacatacaaatatataaaacattagtgttaatgaaaagaaaaaaaagctaaaaagtgtaaaagtgaatcaccctgttaacatttatctgaactttctgggggagaaacctgatgtcatagaccacaattagaaaggactgcacttaataggaactttgagtaattatatgaaacaggacaaaatatttaaaatacttttaagtatcctaaaaaagaagaaatatcacattaaaataacattcagagatgattattggcagctcctaattgccaatccctctgctggatgttcaagatacattaatgcaatatagacaatagcctgagccttaccttccacaagtttactgtttgttggattttccagcatatttaaaagtggaaaatgataatgcaaaagaagaggatcaatatatcctgaaagaagaaaaaattccaaatgaaacagaacttttttttaaatgtcccacgagtgtgtgtgtgtgtgtgtgtgtgtgtgtgtgtgtgtgaatcagaaaaaaatatttattaaggaagaactgaaaattgacatattgcttcaattacattgtgtttggaatcatacataatttttctttagttaatactttgtgaaatatatttaaatatactcctgaatttaactggtcacaaatcactttgtcaacttcataatatgccaagttagagaaacacacaataaaataacatctttggacagtcggtcttctttagagcaattgtagtaaggttagtgatacagcaacaacacaaaacaacaaaaaaccaaatcaaatcgacaaaaaagtcacttttgctttcacattttccacatagtagggccttagggatgacaatcctgatggtggtgagtgagattctcatttgtatataaaacatattgtcttcatttatactgcatccttatctgtgcttgtctggagaagctgctaatggagattatcaggggctcacatcacatcatgccacctttttgagttgccacagttgagttgccataggcaaattggtatattttcatgccacatagctacatgaaaatacaccagtaacagtgtagaagagttttttactggtctctattcataacctacattatctgatttcagccaagatatttttttaactgatggctaaatgttattgaaaattaaatctcctcttaaggataaaactagatcagtcgtctcttgagtgaatttctcagatttagttgtagaaaatatcatatgtatctaattctaatttgaatgttaaaaatgttaaaaaacttaatgcctgtgtataaagagccattaaaaagaaaatctcgccttgactcagccattacacttccggcaatccaaactatatagaaacctatgcccccagaatttattgttgtatgtttaagacaattaatttaaatagccaaaatatttaaaaatggtgaacaactgcacagaatataaaatgtctactagatgaaatgctactagatacactgttatgtagctattaaaattgcattcataaaatatttataataatatacaaattaaatctgtcatggttaattctattatcatataaaactgcataaaaataatgagttcaactatgattacagaaaatgtacattatagaggcagaaataattacatcaaaatattgacaacagttgtctttggtagtgggaatttgaatccattatcttttcctatttttttgtacttcatacaataagcatattttgatgtgtaaatacataaacatcttaactattttgtaaatcctgttctctgatacactttagagctacaagcctttggttagtttctgcaaaagttttttgttctgtgttgctttgttttcgtctctataaaagaacaaacttttctctatgctcttacatcacaacaatcaacacagaaggtttttgtgaccaagtgagcttgggttttcccacacacatcaagcaagcaatcaattctgcagcagacacaggttgagtgtcctctaattcagttcaattctaacactatccatctggagttagcatcagatcccagggtgaggactcagttttcaagaatgccccctcccaccacttcagaagtcaacagaaaggtctgcctctttctgatggacaagctacaaatcattcctacaaacccttcctttgggttcagttaatttattagagctgcttacagaactcagggaaacatgcttacttgtttatcacaaaggaagttacaatggatattggtgaacaccagatgaagagatgggcagggaaggggatgagtgtggcagtgtacagcttccatgacctctccaggaccctccagaagcccccaagtgttcgaatatccggaagctctttgaacacttctttttgggttcttacagagttttcattacaaaggcatgattgactaaatcactggccattgctgatcaccttaaccttcatcctctttctcctctcctgggggtgggttggggcagaaagtcccaaccctctaatcctgccttggtttttctggttaatagccccatcctgaagctacctagggactgccagccctcagtctactagtcaactcagtagcatacagaatttattactttgaagattccaaggattttaggaatcatatgccaaaaactggggatgaagaacaaatatatatataatatcacacaccaaattctgaaattgaaaataaccaaccctgcttatgaaagcatagttgtgattttttggggggaatcctttaattcgtaaattatatactgtacctttactacatatatgacttttcaattatttaataaattattgatggcatcatagcattagttttaatatattcatgttgacttgctatcaactcaaggacttcctttcagctaaataaaatatatccatggggaaaattcttgtaaaactttgttttatgcactattttatttacatctcagagatctaaattatctattctaagattaattgggccaacaatatcttaagaaaagaaatgacagactctaaattggaaattaaatatcagtccactaattagttaatagatcttttaatactgtctctaagtgatcaaaatgttctgtgcttctgctgacttctagcactgaaacttgttcttaaaacctgtaatcagaggaaagagtataatgggaattgtaataggtatacctttttttattagctattctctgatatgcactgatatggatgctttgcatatgtcacaattatgagtaaatatacattatatctcttctgaagtagatatttacatgcctagtttacaaacagaaacaacagtagaaaggttatgaaaattgcccaaattccaaaacccagaaaactgacagattatctttgtatggagtctctctcatgccagtcgtttgttggtggtggtttaatgtggtcgtggatcatatagtaaatacttttcaaatgtttcaaccatagagttaaaacatcttagatatttaaactacatttataattcatattaaaaatatcagctcataattttgtcatcccccagtgtttttacaactgattattgtatataactaatggccccacccttcagcaaaatgtctttaatattttaatattcctatttttaccatgcaatgggacaggcaatgtaaggagtgccatattttcaaattgaagccagacatgggaacattacataaaatgtataaaatatacttccctaaaagaaaacgaactctccaagagataaaataaggaaatatactgaggcattgacagtaatttgccttcacagtgtcctccataactggagacttaagaaatatgagtgaagatatatgtcagtaaattgtaggcaagtaagcaagtgttttaattatcttcctgtgattttctgtctaaatatgaagatatctagaatccctttctctattccaagaacacatttattattgttcactgacagcataagtttctccctaccatcacatttattattgtttaattaaacagagacaagtcaagtggttcagaaagaaaccaagtaaatgaatccccatcagtctttacataattaatgatattctctgtagactgcacaatttattaaattgctgagcagaaccacttcagatacacatatttatgtattctgagtcaaagactattctagaaactgtagaacattggaaactaaaataagtcagtggattttttttaaaaatgtgtaagtatgacaaaatttaggagagtaagaactattaatagtgccccattacttcttttttcattttcagaacctttaatgtagtgctatagcaattttgaaagtaaaatcacttaagaaaaataatatgaaaaattaagatattggaaataaagtatataataaaaaagtactgatttctagggaaaaataaataattccccacactcagaccagatacttttctccctatggagtaaattacaagtgaaattttacatttgaatgaatccggccataggatatatattgtaattattaaaagtctaacatagcaacttgaatgtttcaagagacttgctattttatatttaatatgagtgaaaatatgttttaggaatatgttttttgttccttaagattaagttttgtatacagagtcatagacagaagttttattctttctgtctctgggagagcacagcagtaatgattctctatgaggctaccaacatagcaaaattaaccaggaaaaagcaggctcctatgcagagcctattaataaagaaggtaatgacctctaagcattttatttgtgtttcgtttaggcagaattctgttttgtcgtattttacacattattcacaatactgtttttcaaggacatatcacagactaaaatcactgacccagatgacaaaaattataacataagtttgtattgtgaatgtcaatcatagctgttaaaactaatgtatgctgttaaagaaagagtgtgttgaaccattccagcaaaatttttagtgggaaaatccattaaataattcaggagaaattgtaataattaatcattggccttgaataaattgctagaagaaaacaacatactatgttgtgcttaatgaaacatatacgtgaaattattttcaatttctgaaacgtatcatttcaaatataatgagaattctttcattcatgagtcatagataatatcaaagctgtcttggatgctgttaggacacagtatttctgggatactattaatcaaactgaagaaagtaaaaataggtttataaagtagtctagacccaaaagggaggatagacattaatttcttgtgtgatatattggatacattaatatacaatgcatctttagtacttgaccttaagtgtcaagaatataatgcaccatttctcttttataagcagtactttaaagaggtgtttctggtcaacattattttgtactgcaaggttaaaatgatgaaatgcataaaaacatgaaatacacaacttattaaaatgcaattcaccagtccatgttcaggtgtttctttaatgtcagacctcaacaacaacactttcagataaaaattaatcatcaacatgatgctgtatggtaatggcatgaattttatttccatttaaatgtttacatttctctcaaatcaccaaattaatagtacctttaagtctacaatcaaaatacatatttagatttgtttcttttatgctatttttgcagcaatttttattgatagagtatgtgggtccttagctaacaccaagtattcattggtaatgatatcaaggtaagagctctcaaaaaacaacattggcctcaaatattcacccaaaacctagctgtatgattactgcttgaccaagtgcctttgacaaaatctatctaaaaaaaatcagaccttacctcccttttccagtggagccttttaaggtattcacagctttcattctaatttattgtgaccccatatatctacaagtgtaattggactcttaaagtttttagaccaatccaccactagtagcatagtagaatgtatcatgcggtaccgtgaaaaataatgggaactgaaataagaaagacattcatttatatcctgtctaaatcaattactctcttggagacttggttttctttaatggggattaaaatgctttccattcaagatgtactgagtttaaaataagcatcatacaaataatatcttggtgtatggtaggtttccataaattttatctagcttccttcaaataacattatacaaataacatactacattcctactagatttccatcagttttagttgaatcctttcaatctccttcttttcatttatcaatcataacaatgtgttagacaacagaaattttttttagttacaaaatactttcttcaaacagaacaggactgtgttttttttttttttttttttttaactcattcatgaaacaaacattttttgaggcatggttattagcaaaaacattccaaataacgaaagagtggaggatggataaatgaacctgctgttggtttctccctttgttctaaataatagatgtagacatattttaataatagcgattagatgaaagtctgcattatatagtttaaattactttaaaatctctgatggaacttaaaacaagagaacaagtaacaggaacttgagagttagaaaaatattttttaaactttaggcagaaataaagcccaaaattttagtatatttcctgccagattattttatatcctagagataccattaagaaatgaaatagaaacaaaaagctgttgtaatgtagaaacagttaccacaattcagtaaatacataagtaggacttaatttttttagttcctaaagtatgttcttattcatactatatatgactttagcagacttatttacttatttatttactttgaaggagggagtggtggtgtttgggtatataaataaatgttagctgatgacaaagcaactcttttaatttatgaataaaaactgctaggcattaaaagttatttcctgaattatctatttcccaaggtttaaatctttaacttaatactcaatatgtaagttttcatcctgtgaaaaaaaaaattactaagtgtaacagaatttctatatttcactctcttctgtcaagaaaaatttcttttaaaagactaattatttatagttgaaataagactgattagtgttgcttgttccaatgactaattaatgaggaaatggcatgtccttaccctttgatttcttgctgattaataaatcaataaagtattactggaaggaaaaaaaaagcacagaaccacactcatataatgagataatggttgccctttttcactttctgaaaactcatagtctgaaaaaaaaaaaagtccacatcataaatgaaattagctgggcccattgccagacttttgaaggaggactagaattgatggctcatgaagattaaattatttattcactcctggaacatgaaacaccaggacagagttgggacacagccattatggtcgcagcttgtcattgcccttgctgctgtgggtttcatttcttaatatacaggaatttcaaacttcaggtttgttattataggtcagttcttgagatgggcctcaatctagtccacatcttcatgacacatccaagataaaaataactgctaagatttttggtgtttcccagtctgagtttctaaagacatcacagagtaataaaaaaaaaagtaacctatataatgtaggcaggcattagccacctttgagccttttatgctgtgtggatataacagctccaaagtgaggaattaggggcttcattgtaaacccctaaaacttgagctcctttgatgcctctttctgtaggtgatgctgtcgccatttaaatacctggaaatgagccatatgaggtgcagagctaatcttaaaatccaagtagaaaagacttcagccttccattggccctcaagaagtcacagtcagaaccggtttgagagacaggtaggctacctcacttacaaccctacgagtaggctgtctccctagccacaggattctctgggtctcttatgggcactgcatgcaaaacttccttcaccttggatctcttaactttagcctcctgaatcatcctgttcttatgcaacatcagctatcattttgaactcaactagtccattgcctgaagcataagagtcctaaagtgtcaaggccagttgaggcctcacccagctttgtgattttaaggctgcacttttatagatgccactgaaatattctttagatttcatgaaattttgagttcacaagactaatatttataccttaaagaagaatgcttatagatgatctggctttattgctgcagacagaataaattagacattttttacaaaagtcaaatgtaaaagtatagtatctaggatttttgtgctagtacttaaaataaaggaaatgtttgaaataaagggaaatttatccaaaatataattatgtaatcaatcaattaattcaaactgattttagtaaaacttccatctatagaacagctttcttttaatgaataaaatcattaatgaaggcatattgtaaacataaatatatggacagaatagtccagaaaatacagaatttggatgcgttgcgtgagttgtcgaggtgaagaataaagcatcttggacaacaggttgagcatttcaacaagaagaaaacttactgtacagggcctggctgctgtgtgctcccctagatgcctgaaggttctgtctcaaatataccattcccacctcctcccttctcccccagattaaatctgttagtgttttgaaatacccaaacttttcatgtttttaatagacattttgagtaactctggacaaaaaggcattgctagattatgatgaatatatgcactctggagttactatatctgaattcaaaaggtgccctgaaatttgctcattctgcagcctttgtttggttacctaaactctttaaacctcagtgctaccatatgtgaagtgaagatgattgtcttcctattaagactgtgtgggacttgagtgatgtagtacacaaaagcacttaatacataagatgacttggaagagaagagatactaaaatggtgtattttaatttttctccgcctcccgggttcaagtgattctcctgcctcagcttcctgagcagctgggactacaggcatgcaccaccatgcccaactaatttttgtatttttagtagatacggggtttcacaatatggaccaggctggtttcaaacccctggcctcaagggatctgcctgccttagcctcccgaagtgctggaattacaggtgtgagccgttgtgcctggcctgagtatactgttaatatagttttccaccaccggttaccaggctatacctatatcataaatcaagtaatcctataaatctcttatcagaaaaatatagctattatccccactaaccattgcaagactgacggaattctaatatttaccagagtactttggtctaatggcaagggggccaagttctctgttgcactgtgaatgggttgtcgggtaagacagacaagactacttcatttttttttttttcgtggtcacatgtgtctaaccctggacggtcatctcatttccacacacttttgttttaaggtaagaggcctaaataattaagaaccaatcaactaccctgagataagattttgcctcaatagtggaacataacacctgaaaggaaagtgaaattgaatgttgattttggagaaaagaaagaagaatgaaagcaaatttttatgtgttgacttagatagaggccttgcaaacataaacacatttaaccagcaaacaactctagggccctttgcaccaaacgatgcaaaataaaaatgcattaatttcattccaaaagctgcatccgtgcactttatgtaagttgcttaaagattaggaaatcagttactgtgcataaagttgaccttcatttcagacatctgaaaaaaatatagttttaagttaggatgatgataattttcctccggcaatttcgaaagaggtgtaattttgtagctaaagtcgaaatcttgaaagaaaagtctacctttcaaatatgaattcttaatcattaccttgatgtaaaatcaattaccattaccaagcaaaaataagtaagtgctcacttttttgtgaaggtgacattattcttttaatgctgtatttttaatattttcctttttgctttataatgggcccacttagatgtatttttgttttccttagtccaaattttagtaacagttttgtgctttggatcctgtcctgatgggtttgtaataatttttacagaatttttaaagagatattaccctaaaatattagagttccatataggttcttgaccacaaactagcagaaatgtgaataggtatattggaatagcttggccacttcagaattagtgagtcaaacatgaggaaatactataaactagagacagcagacctagaatttatatattatttattcaacattaacagtattatcagtaaatattctaaaattacagtaatgctattaaggaaagaattttctgtagagtatataaagacaaattctatattttttaagtttattaattaagtatattaaaatttcttatcacagaatgactatgaataataataattcatccatagatagatacagcttttctggtctgtagaaactgctaaaatcttatcggattcatatactgaaattttatattttgtcatgctgtaatgctcattcaaagatattaagattctgataagaagtgttttctaaaagcaaaataatatttttgaaaatccaggatatatagtttaatatacagagcttcttaaaaatacatccagatcgcagagtgtattcaactaatagtgtgtgaaacaattaatcactgggggtcagttttctaatttaaagtgaggtggtttggcctgaagtacattattttgaagcccctactatgattctgtgaactatttgacttactaaataaatgtggatggaagacgtagcattcaccaatggtccaggggatgctaaaaacaacagaacccttgctagattgacctaattgggagtctggtgtgtccctgttttaagatggtgagttatctaacaggcacagaacattcagcccaggtatgtaccctacctttaatcatctggacgtataatgattttgagcattagattcccaaagtcatgaatcctgttgaaagagcaccaatgaaattccaaattgaccagagtattttgccataatattatcaggttattttatgagtaattacattttattatagcaattaagacatctaattttgccagtatggaacaactaaatatgagtttaagtttgaatgatgagaagatttcaacttcatcagggtgatgaaaaggtacatagaatggtcatgaagtagaatgaaatacagttagaaaatactgatcactccagcatgtctagggcatggggcccttatagacacaaacaaaatgctcttcataggtgatgcttggtttctgttcagtacattgtgttcttccaggtgactaaaattgattatttgatgatgcctgctaatatctcccccttactggagttaacctgaacatgagatgctgtgattgccagggctgtcttgtgcttaacagtgttcctcattgattcagtctgaaagtctaaagtgctctcaacagtgtagccccttatgccattggacggctactgtagaagtgtccttggaaaacactgaattttatcaacgactggggagtagttgattaatttttaacgtacttgcttctataaatctaagttgccatttccagattaatttcatttcagcagagttgtttatgtgcatataaaggtataatttttaaaaagtgaaatttcaatacatgtccaattctgttggcaaacctcaaaatttaaaagaagctttctttatatttttaaattatgcttctatggtagccataaatctcagtgcacttttctgagtggaagccttggctattgatcaacctttggtcttctgcagctgagttaaatatcatggaaacattagtgttgaaaactaaatagatgaaattgtaaaacctactttacttaactcagtgacagtagtatttgtcatttatttacatgacgacactgaaaatcaatcaaatgtcagattccttttaactactttaacagaatatgtgagattgttgtatgttgggcaactcaagaagtaatttattcaaaccctaatgctggaaattaaataatatgactagaatgactactctggttagtagaacacttttcatcagaaagttgtgagttaaaagattttaagtaacccaatgggaactagattcaaatatcccagttcccaagccatgttctctaattcagatataaatattagcaataaggatgagtacctcataatctttgtgtttccgtctgtagaaatagcttaatgccacctgtcaaccaatgtctgaataaactaaatttggtaaataagatgccatcattgtttttccatggaattcagaggattcggttactgaaatccatggcattaatttttctgcctaacagcctacactctatattgatttttcatatagattaaatttcctttttaaatttgcattgactctttaggcttcggtttcctcatctgaaaagctggtaaaacaatagtgctaggaagaggcttcattgtgaagtcaacaaagattacacctcaaggctacatttgcaagtgcctacacaatatatgtgcattgctatatgttgttgtaaaatttttgaataagacattaatgcattcattttcttaaagaaggactctcatattctttaaaactcagaccccacaatacccagatctacttttatacaaaatccctaaggatgtgataaggactaaataagatcatgtaaatgctctttttttgcaaagtatgtgcttaaatataaactgttgtcattatgaaagtcattcagtgtagggttctatacagttcaggagtcaaaatactcacttgatacagtgactgtcattgtatttaccattcaacattgtttacatttacatacctggctttgttatttccagaagggaaaatccacgttcaccttgtttgcctttcaaccccagacactaggatggtgcatggcacactgaagacactcaataaatatttattttattaatgaatatgaaatatgacttagcagtacagaataatattcaaattgtgaaataaaatacactgaggatcaacactgttatttaaaagattctgttgatcctaaattttacaatgagtcattaaatgtattgctcagctttcataatcttcaatctataatggtttatttttcaaaaaggctttaatttccttggattgttgtaaagttcagagttattcctttaagaaacaggctatattgcattgcaacaataaccccagaaaaataacattagtagaaataatataattaaatattcatataagataattgacttatctgctttactcaaatggattttaatgataatattggactaaccctatgtgacagcatctgctgcttttatgcactgtccccttacctccctcggccccctgctttgccaatccttccgaacataccctggaacatttggcttaaagtttcagaaaatctgctccgtttgataatgtcaactcatcacatttcagttaagcagacatcaaatcaaatgactcatgtcacagatacataaatattacgtacatggaaaggaaatttttagctataaatgcataaaatcttctggtttgtaaacctgaactacattttaaaattttgacagtaagaggaaactgatgtgaaactaatacataactctcaaataatccaatggccaactgatttggaagctactcatacaaaataatacttgcgttaaaaaatgtcctttccttaaagttactatcttaacaaatgtacaatcataaatctactaaaggtaaacatcatttcttataagaaggatatattgaactgcatacacatcttactgtcttcaaattccttcaaaaatataattaacccatccaccttatcagggttagctcaaggaaattcgaaaccatcataagctaaaaatcgttatgtgattgaacctcatcactagataagtgattctgacaaaattgccattttatggaattgatcagaaatgccattccaagaaagagggttcgccttatgaaaaaccatatatatttttatatctatattatcttatatgaataatatatatatatttttttacttgcctttggaaagaactttgtaaaatttgttaaacttcctgtatggaatgaagtaccttattacacatttctactcttgttaaataactgggggaaatgtgttatatctaggcctcactttataaatatttgttgaacttattgaattcagacaaggaaggccagaggggtttgtgtgagctgttctctgccgtcggctgatatcgcatttgctttgataaataatattttaccttcccatttgggtaatgcctgccttaggttgagttcttcttaaagcagattcttagatgaagattcatacaagtggtttatttgtgaattgaaagaaatacatggggttatggggaaatgagacagggaagggaggccagttgctaaagtcaaaacaggtgcctctaagctagctgccacgggaagggaatgtagatgagtgtccatatgtcaatgccattggtcattagatgtttttgatgaggactgctccatgatggttcatttcctggctcttgcaggctgtcatgaaggtggcaaatgagtcttcagggacaggagagcaccctcaggaaaagaagccaagaagccaggggttggctttctcttggaagttaggcagtggttgatgaggtgatcaaggtgggagatatgagtggagaacaatcagcgtctgccagaatgacaaccatttttcacatcttccttaatattttaaaaaacagatatattctaagacttttcttataatgactagagagggttttaaaaagtggttttatatttgatggaacccttgttggtgctgcagttaaagagttacttcaaaatcctgcctcagcacaccctgttcctttttctttgcactccccgaagccaatgtttcagaagcaactgccgatcagcagaattcatctgtttctcccacagggctaatccctgaccgacctggaagccaagccaggctctaacctggcagactcactcttctcctgctcctcttttacgtaatcccatgcttattgattctctagaaaatctgttttccttttgctcaaagcagagtacaaagcaagaaactgcctcgcactctggagaaaacacatgaaatcacaagctaaccagtgactgtcattccataaaatagcagttctattaaagtgcattatgtaaaaatgggatttgtactagagttgttttataggaggttggtttatatcatcacctgtttcattgaaaatttggtcggtgatgagtcatccataaaactggcagaataaaacttcaggagtggctgttgtaaagttcttctaaggctcataaaaccgggttatgcgcttccacagttttgatattgctcaaacatttcatcaaaagaacgtgaatatcatcagtgctacattttaatttgatttttaggaactttcatttttaactttccttccatgacccctgatcttttatttgaaagtatgggaacacttgacccattgttcctcttcacattggatcagagaatacaaaagttaaactcttacacactgctatagataagagagagtttaaatgttagttatagaataagaaccttaacgcttttgtgattatataaaaataaaagctagcatttgctgaacatatgtactgtttcaaacattacattgacttatgactcactgtttacgttcattgcatcacatactctttatgacaatcctgtgaaatagttgctcttttcttaacttttatttcaggatcggggtacacatgcaggtttgttatacaggtaagttgcatgtcacaggggtttggtatacagatcatttcatcacctaggtaataaacatagtacccaatgggtcacttattattatccacacgtattaatacttagaagaaacctgaggcgcagggaaattaaataaccatttaaggtaagagtcaggaatcaaaccctagtttctctacacgaaagtatgctttaaaaaactctactgtgttatgaaataatatgtgcccatgtgaaagaaatatatagacaaaattaatctaggatggaaaatatcacagtggtggttgcctctgggtggggggattgagactgacctggagggagcatgagagaactttccagggtaattgaagcctcctatcttaaccagcacatagttatatatagattgtaagagtatatgcatttgtcaaaacatattcggtggtaacacttaagatcaatgtaatgttgttcccctcttaacttatggatactaggcttaatatatgggtgatgacataatctgtaaataaacctctataatacaggtttacctatgtaacacacctgcacgtatatccctgaacttaaaatacatgttttttaaaaagatcaatgtatggaccaaaggcaaattatacaggcacaccttcccaggtgtgctatcctcccacctctgtttttagtcatagaatctgaatggaagcagccactgccctcatcctgatccccaaaccacgtgagagttcaaacgttgtgcacaagacccagtccagccagtaagaatccttaccaagaacttttattaaaacattgccatcggccgggcgcggtggctcacgcctgtaatcccagcactttgggaggccgaggcgggcagatcacgaggtcaggagatggagaccatcctggctaacacggtgaaaccccgtctctactaaaaatacaaaaaattagccgggcgtggtggcgggcgcccgtagtcccagctactcgggaggctgaggcaggagaatggcgtgaacctgagaggcggagcttgcagtgagctgagatcgcgccactgcactccagcctgggtgacagagtgagactctgtctcaaaaacaaaaacaaaaacaaaaacaaacaaacaaaaaaaattgccatcaaggttaaaataaataaacgaaaaaataaaaatatatatatttcttttttttcccctgtggtgagaaatctgtaaggacatgagtactacttgctgacaaccaagtcctccacttttggagaaggtagtctaacacttcaaatgtggctaattcaactaatgaacttttatttaattttaattaatttaaatttaaatagccacacatggctagtagctaacacacggaatggcaaagctttgggagaatgagtcagatatccacagggtgtaagacataagtaataagaagaaagagccctgatggaactggatctctctggaagggcagctccacccctgcccttcttgtaatctggagatgtaagtgtattagtccattttcacgcattataaagacactatctgagactatataatttatagaggaaagagatttaatggactcacaggtccacatggttggggaggcctcaggaaacttaacaatcatggcagaaggcaaaagagacgccaggaccttcttcgcagggtgacaggaaagacagaaaagttcaggggaaattgccatttataagaccatcagatctcacgagaagtcactcactatcatgagaacagcatgatcataaatcacctcccaccaggtccctccctccacacgtggagattatggggattacaatttgagatgagatttgagtggagacatagccaaaccatatcagtaagctaatgaatacacatgccttcatctctgcaaatgattcccctccagaatattaccctttaaagttacgattaataacataaaaatctttataatgctgtttgtaaaaagcataaaatgcaaatgtgtgggctgaggtaacacttcactataactaagtttccatttatctaacaaataattagtagataaacccaaatggctaattattgtaaacttttccatcttcataaaaatggaagataatataaatagacgaacagcactagcaccttcagggcaccaagaagacaggaggctgaggcttggaaagaacaatcttcacaactttttctaggattggttgtgttaattttcaaaagtctcaggtaaatgagatgggtctggagcaatacctttgcatgatttatgtgattttttttacacttgaattacttcaaggagctttccaaagaatgttttaacatactgtgaccaataatgtcagagctgatggcagcatctgtgattatacttttgaattctggctggtagtgtcagatttgtagactgacattattatttttataatagaagttataagaacacaactctaaagattatggctcatagaattttagaggtggaagaggcccttagagaacatctagtacagccccttaattttacagatgaagaaacaaaagcccaggagaggcaaactgagttgccacaggtgatgacacctaattactgatcgagctgacactaaatccagttctcctaatccccaaagcttgctgtcagtgagccaatcccaatacatcataccattctgacttttgccttttcaaatgatgtcttaattaccgttgatatattttataattttgtaggagctgacaaatttgtcaggacaaaatttcatataatgtgatatattttgtgactttggcgtcaaggaatgcttgtataagatgtttgcccttcatgaaaatcttgaagtattggggaatgcatgctaaaaaaaaaaatcactagttttcaatgaaattttccagctaggtctaatatcaatgtatgcaaaattatcttaaaattgtctgtatttgccacctatatcatcatttacagtatgatagttgcaggaaggacacaagctcagatttgggtagaccaggttcaagtcagccacagcaacttcttaactgttcaggctttgtttgttcttgtgaaaaagagattaaaattgtactagtatagaaagcacctggtattatagtttgtcctatagagataataaatatatagtaaaacttaatgaattggattatacactagaacattttcacatttgaactaatagtgtgattgttatgtaataaatgtggttaataaaatattgatacagtataaaatatataatatctgattaatactaatataattctgttacacaaaaacttttaaaacgttatgaatgaaaaaaattagttataagcatttgagaagattttgcctgggatttggaattattggaaacctagtagatccatcttcttgcagacctagaatagaaacactttggaactgaaaagagaacaagagataaaattttgttgcactgctttctgttcaccttcctcctgacccttcaaatatttcatcccacccagtctgaggcctatgcccaaagtttgattatacattgttattagataatgtttgtgcctatcatcactgagaagtacttccagagtccagagtcgtcttcacttgcattataccacaggttggtccttaatccgtgtgagaatgaatctgcatgagttgaatcactccatttctgaatggaccctgcaggtcctcttcccacaaccatgaacaactttaggatattgtcacttttgtaacttttttctttcccacatcctcacaatatcctccctttgtgtccttcccaataatgctcacacatgattcaataactgcaacaatttatactgaaggctatatatgcaacaatatatactgcaacaatatatactgaaggatatactgaatttatacagaaggatatacgtataaatatacgtttaaatatacttttaaatatacttatatttaaacaatatatattgcaacaatagatactgaaggatatactgaatttatacagaaggatatacatatccactgcttcagatccttgtcttaaaccaatctggagatattcaaattattgataaccctccagacctggaatctgaagctgtagacctgaagattagcctgatatatttattttcccaatatttataatcaatcagataaagagtccgatattttctgggtaaaatcctaggtaaaatatcaaataaaattcactggaagtactcattatatagcagattactgaatgactaaaaaacctaatagagaattctgttgtgagagcacttctaacataaatttattttataatggcaaatttcattagaattcagaaaatgtaatgtctattcaggactgtttacttcttaacatattaaagacaaactatattttgctaggtgaacaagtatttttcttaagtcaatacaaaggattggaaaattaaattttcattgcattcaaggaaaagacaatgaggttcctatcatttatgtatcctcagtgcctagcatggtagcagcacatcactaattcacaagtgtttgtgaaaggaaggagggaggacaaaagagaaaaggaaggaagaaggtttgttacagcatgtcaagaaggtggaaatagaacttagattcaagactctggtttttgatttccctttgaaatacccattttttaaaaatgcttatgttacctagaagtggtaattactaagtcattcattctagcaagaaacatctgagctgctactatgtgcagacacctctggggatacaatacaggtgaaacacaagccactgccctccagatatccacaggctgacaagagaaaggatactttgtacatttctgtaaactgctatcaagaacatagtaatgtcctgtagcccaatgatggaaggaggctggaaaatggcaagagagcaaataaatttggagaataattgcttgagcaaaatttgaacacttaagagaaaatcaatggtcagatatgttaaaaagatggaattcctggtagagaggatggcaaatgaaaggattggggcatgaaactgtggtgaaatttccctaaacattcagttagtttggtatgactaaagcatagtgtgtgtgtgtgtgtgtgtgtgtgtgtgtgtgtgcgtgcacatgtatgtaggtatatgtgcatgtgtatgcatacatggatgtatagaacatagggtaggggtgggaaaaggtaaattttttttttttttttgagacggagtctcgcttgtcgcccaggctggagtgcagtggtgtgatctcagctcaatgcaagctctgcctcccaggttcatgccattcttctgcctcagcctcccaagtagctgggactacaggcgcccgccaccacgcccagctaatttttttatattttttttagtagagacggggttttaccatgttagccaggatggtctcgatctcctgacctcatgatccgcccgcctcggcctcccaaagtgctgggattacaggcatgagccaccgcacctggccaggaaaaggtaaattttttaagatgacagtgaggacacttggtcaagatgaaacaatagtaagatcagggactatgtatgatgcctatatgtgccaggcactgttgtaatcattttatacacactaacttattcaatgaacacatagacacaaacccacacacctttgagctatatcccattgtgatcatcctgaggtacacagaaagtgctttgttcttgtcacagagctaggaagcagcagaggcaagagttgaaactagccagtctgtagagactcgcatatttcatgccaagatgtttggacaagagaggaactgaagcatgctaataacgtgattaatatccctagattctgactaagtttgtggaagttatttataaggaggaaagctggagaaccaaggcaacaggtcttcttggggtcagatgcagtagctcaagatagcagaaagaggtcagtgaagagactttgatctagaacactgagacctggtcactagcttcagtaagagtggacatggggaggactcactgtcacccttctgtctagtttaggtgaatgagtgagaatgaggagtttgatttccttagtgaacctccataggaagtgtctggcacacagctggaatgcataagatacagctctggcaatcttgactctagacaaacatggagttactatcttcttaactggaataggtagaaatataggacaaataccactgtcaagcttcccgcttttcacttttatttgttattataatgtagctatggaagatatgcaaagaaggaaaataaagtaacctccacaccaaagtattattattaataaaaaataaacacctagctcttatcctaaagaggttattaccaagtggtgagaaatagttataaagtataataagtacatataagccttaaatttccaaacagatttgcataatttagcatagcttgtgggtaatgatgatgataaaatcactaaacatctgctaagcatttaaacaacattttccttccgttagcatcagttgctggaaaataacatactttggctcaaattgtcctgttaaaaatatagtttggggccagcagaattttattcatgcttttatatggagtctccacttttttctgtaaatgtatttatagccaaaagctttcaccagttaggaaatgcagcagatgccaataagtacattcattattttgattatggcaatgtcagactttcagaaaacttcctccatctctatctgtagcacaacctcacatagggagggaccatgtgctggtcaggaaataaacagctttctggcaggagttaaatgaaaatactgtttattactcttataagatgttataattgacggttttattgtaatacaatagcgattatgacatgttgtcccaaaccctaattttgttgttttgtagcaagttacgtttttatcaaggaacacagtggtttaaaaaaaaaaaaaacccaaaaaactaagatttggggccgggcgcgatggcttacacctgtaatcccagcactttgggaggccgaggcgggcggatcatgaggtcaggagattgagactatcctggctaacacggggaaaccccgtctctacaaaaaatacaaaaaaaaaaaaagtagtaataataaaagtagccgggcttggtggtgggcgcctgtagtcccagctactcaggaggctgaggcaggagaatggcgtgaacccgggaggcggagcttgcagtgagctgagatcgcgccactgcactccagcctgggtgacagagcgaaactccgtctcaaaaacaaacaaacaaacaacagcaacaaaaacgaagatttggataattcatgtgtcttttgttttgatctcagaatttcctcattaacagatgtgaaataatttaccaagtttttcttcaaattgactaggcctgtataaaataacagaaatgccctttgcagtgaaagcactttgtattagggattgatcactcaattacattctggatgagaagaaaaaaaaaatcctattggtgtttttatgtgattacatttagggagaaaaagtttggaaagctaagaatcttttgtgggaagacaaaaagaaagagcttttaaggggcactttgaatacagagagtgactttagatagctagcaatgctgtttaaaagttacatcatggctttaagcaaaatcaacagcagtgaaacaaactgaacaagcagaaaaaaatataactcgaaacactgatgagtagtagtttttgaaagtgaattcatccaataaactacatcaaataaaggcaaataaagacaatctaagcttcattcacaaagtacatagagaaaaatgcttgaaaatatatcacatccaggaagaattttttaaactgacaggtgaagttattttactatatataaattctttaaggtggcagatatcttgtcaaatgaccacccttacaggaggacagtcaacttgattctaattaataaacaaagttttagtggaaatcctagaacacgtagattcatgagactcagcattcaacttggaaacccgcagaaactgtgtatctaagccactctaaccaaatagaagaaaaccttctacatattatgtgccagggagacgttaggcattagcagtgcacagacagtcatggttcaggctttgacgctgatgacaactggtggaatgtgtgttatctaccctgttattgtactaacctatcctctatcctcatcacacagtatgagaactacagtagcttgtcttctgcctaaaatctcctaccacttccacagtcatttaatctgccagctcactgttatgctggtatttttaagaaataatttcatataattagtctctttctggatgaaacactgctaaggtgtttattactaacctaaattcagtccttttcagctctttcactctttgtaatccaattccattctttgcagccagtattcatttctgcttgttctgaaatctatcccatcacttaggatttggaaactagcagacatgaagattggctacaaagaatgtaactagatttttaaacagatttagctctaatcccatttcttagaacaattcccaacttgaaacaggaaatatctagatggtttcactgtccgattctgtggtgacccaacctcttagcactcagattctgcctcggccctactgagattactagtcttacccaacatacaacttccttccacatctaccaggttgaggaatgaagcaaattatgtgaaataggagaaatacttttagaggaagcttgagtattggtgtattgggataatttatatgggatggtaaagttagagggtagatgatggcacttcattacatctgcaaaattttaaaaaaaattatcctagggctaggcatggtggcttacacctctaatcctagcactttgggaggctgaggtgggaggatccgttgagcccaggagttcaagaccagcctgggctatatagtgagaccccaagtctacaaaaaatacaaaaattgaccaggcatggtggtgcacacttgtagacccaggtactctggaggctgaggtggaaaggattgcttgagcacaggaggttgagactgcagtgagtcaagatcatgtcactgcactccagcctgggagacagagtgagaccttgagactttgcatcagaaacaaaacaaaacaaaacaaataaacaaacaaacacgttctggaagtagtatgaatggtaggttgagagatgagggtaaattcaattgagaaagggatgcaaatgagaacataattattagtaatctaaaagagaaatggtgaggggaaatttttaattaagataaagtaaaataatggtgaaatcatgaatttttttattttgtatttcatttttaaaaatcataaccacatgtacacttcattactttaagaaatgttacttttgaaagaaaaaatagtcatatccattgactctcaaatattcttatgagttatttatactaaatgaatgaaaaaggcagagaatacaactatgtataaaatatgagcccaattttttaagacacacttatgtatagataggcatagagagacagatgggttaagagatattaagagaggaatgatgagagaatagaaaaaaactttaggggctgggtgtggtggctcacgcctgtattcccagctctttgggaggccaaggagggtggatcacttgaggtcaggacttcgagaccagcctgaacgatatagtaaaaccctgtctctactaaaaatacaaaattatctgggtgtggtggcatgcatctgtagtcccagctgctggggaggctgagacagcagaattgcttgaacccaggacgtggaggctgcagtgagctgagattgtgccactgcactccagcctgggcaacagagtgagactctgtctcaaacaaaaaaaaaaaaaaaaaaaaagaaaaagaaaaaaatctttaaggagatatgcataaatatttcattggttgactctagttattgacactataactgatttgcatcttctttcttgcactttcctaatttagaaaattcaattaatatttctttaataaagagaacattgagtgtatctaaaagtatgtcaattggtgagtaatgaaagaaagtgtcaataaaaataaccggaagagtgcagagaacaggtgtagaaatatcaaaaaggacaagctgacaaaagttttgattggtggttcagggataatagagagagggagaaggcaggcatccatgataatttacattttcagctgcatgttatgcatggctgttgatggaatcagcagtgcagaaggctcagcataaataaataggaggtgagaattgttccaagtgaaggagaggttggctgtgggaacattcggtctcaaagcagaggaatattttaacactgacatactttcaaattgctacccatggtaacagttaaaagcaacttcactgtatttggttttgttattattattataaacttccacttcctacaaagcatgcactccatctttgcacctgaaaggagttgttttcactgctgccctctaccttggttcatgactgggagaaaagagctgaaattctacaggattcattttgagagagagaattcaaagcactatagcgttatagctgcaaatatccaagcgatatttggggataagtgtgtgacactgaggagaaatagagtttgaagataatagtttaaatctttgtttagtagtaaacactttcattagtggcctaaacaccttgtttagtagtaaacactttcactagttgcctaaatgaaactctcaacagcataactttctagctgcataatttcggcaagtcccttaatctcactggacctcagtcttctcatatgttacataaagacgataacagtataaattctgtagagttgtataaaagttaaatgaatgaatagatgacaacagcttagaacatggctttagcagattgtaaatactatgtaaatattggatattttattttcagtatatgtatatattctttctacagagcaagctctttatgcattaatagtaatcttgctaaaaatccaaatctattcagaatgagtactacagaatttttcttatagaaatattaccaacattaactcctctcttagataaatgtgattcacatttcatctctttatgcaatttccttattgttttatcattttcctattgctctattctataaataatgaatacagcattttaatgattcttgtaaatagagaccacattttttaaccattgagcatacggacaaattttattcataatattttatttctttcattgtacttgagattaatagcacaatttctcatccacaaagtttattataggttgtaaaaatgaacatgatctctcttctgattggctcagaaaagaagtttaatcttatgtaattatctttcgaatcacacatgcatcagtacaatcaagctctctatctattagatcactgaaccgtttcacatgagtttacagattaatattcatataaaactatatatctttcagcatatctcctcttggtaggttttcttaaagaaaaacaaaaaagagtagcaaattggaaccttggatatggaagaactgcttaaaaaatattcaatgaattgccatcgggtcactttttccccttataaataaaaagttggggtataaaagcagaaatatcattataaaagaactggaatgtcagaaaacactaagaacattctgtttcagtggtatacaaacttgtttgtccttttaagccatgaaactttttctttaaacaaaatttcttcaaaggtctaattcttaaaatagataaactactgtgaagggcagatgctacgaggacaccccatgacccaactcccaaagcctttctttgtaatctctctgctccaggtagtggtttgaataaggacggcctaatccaaacattgccttttagagagaccttgagaagcagtgatgtagcctaggttacaaggtaatccagtaaaatgtatccatgagttccatgcgctgacagagaatgcattgttacattaattttttttttatatcatcccaactatggaaacttcagttgccaaatgctactgctacataatgtattcatcttttggtagtaaacttctctgctccagtttatttttcagcctatgaagttttttgttttttttttcttattaaaaaaatctcaatttagaaataaaaatgagacaagcacagtcaaaatttaaattagcttggtttcagttcctattattaaagagatttttaaaatatcctacttttgaacatctttgctgccatccttcatttctctcacaagggaaatataattcagcagagtcaatcgtgactgttttgaatatggtttactaaattcacaaacaaaaagtgtctctgatagtcaacacaaatatataaacaagcattgagtaaacggcaagaaggataaaaggcatttttccaaatgaagacttccattgaaaagaagaaattcaatgaaccttccttaaaacatatgaaacattctattgaattttgatctaataaaaaattgtattaaatttgctgtattagaactgttacacacttgagatcaaaaaagaaaacaaaaaatgccctaactataggtagggacattgtaggactaatggaagtgagtatataagtccacttggcaccagagatttttttctaatgtggaagtgtcaaaagaattctgctccacttcaaagcagtgcctggcaggaacaggaaagcataaatgtcactgaacaaacttagagacaagcacttccttcactgaagagaaacctgatatctttctagaaattctagtatgctgatacaaaatgctagacactatctaatttcattcctccatattaatcagcaccttaatgtatgttgcagtttatagacagtaaatatactttaatattttctttctttgcatgggtaaagaataaagaatgcaagtcaatagaaaagaaaaattttaaaataattgtagtaattggctataactggtgagtatagcttggctttggagtgatgtagccctatctttgaatgctggctccactatttgttatctatagaaatagacaggtcatagaaagcatttcccatctggcaatgtacttgtgaagattaattaaaagttaatctattggccgggcacggtggctcatgcctgtaatcccaacactttgggaggccgaggcaggtggaccgcttgagtcaggagtttgagaccagcctggccagcatggtgaaaccctgtctctactaacaatacaaaaaatagccaaccatggtggcaggtgcctgtaatcccagctatttgggaggctgaggcatgagaattgcttgaactcaggaggcagaggttgcagtgagctgagatcgtgccactgcactccaacctgggcaacagagcgagactttgtctcaaaataaataaataaataaataaataaaaagttaatatatttaatatagcttgaagaacctagaataatacctggaaccttataagcattcattaattggcagctagtgagtcctttaagctctatgattgcaggaaatatacattcactaggattacctcaagtaatggggaaatgtttttggaaaatagatatggatcaagtaagttaggagttctgaccctgcaacatggaaatagggcacacccaggtcccagttcagaaacaaggtaaagctatagtggtactcttggccacatctccttagtaagacgcaggagtgaacctgttttccttcagtattgtgactagctctactctacttctgcatcaatcagtcctgttcgcagcaactagtcacctcctcctttgtttaatgttcatcatctttaaacatcgacctgcttatagtatccacttactcccatgtctgctgacttatagaaaagcaaggtacaggtatgtgaatgtagaatgagcataaaatataattaaattaaagcgtaatcagcagaaactctgtgcttttgcatagtaatcctaccagtgaatgattctttctttgtatcctattttgacccatcaagacaaattttattggtctaattaataactaagatcccttctgagcaaagctcttctgtgagactacatacagaccagtctataattgctctgatgaagtgcatccgggaatagggtgaggattggtttctcgtggcacctatcgcagccatttatcctggaagaattccctggaaaggaactgcacatgtggcacacacttttagacttagcatttctatacttctcttgtccatttgtgcagaaaggtggagagataattcagaaagagagctagtttaaagctagaataaaccatgcaaacacattttttttctaatttttgcaaattttctccaatatcctgaaggttaaacagaggttattctgttctgttttctatacccatgctaaggttcaagaaactataaaagaggctggctgactatctctcaaaaggcttcctaggagaggttttccatggccctgggtctggacttcacctagaaggatttaaatctgagttgattaacaagatgatatccttcatggaaaaactcacaggggcaaagctcaaaataagcttgttatgtatataaaaaagacaatttatcaatttagaaaagatgccctgaatgcctgtatgtgtatgtgtgtttgtgtaattttatatattaaataatatataattttaattgacagataaattgcatgtatttatcagcctatatttttcatgacatagtttttcctctggaaaaggtaagtagaaatctaaattaaaagctgtatattgctcaatgaatttgaaattgagaaatgtgtgtagttcaaatattttgtctagctacctatagggatatgcttggcctaaaaaaatctttgagccagagattctcctcatttggagtgagactaggtatcctccatattagcctataagaatctattgtttttttggtttctgctgtggaacacttctcctgttgggacattctgcattatttatattagtacatcaaatcaaggtatagacttgtttgaaaactattctatctctctaataaccctatacacttattcattcattcattcaaaaacttacttactctgcacttattatgtgcctgacaccttaggcacataataagtgacaaaaacaatgtcaaagacattgacatttgacgttgacaaaaacaatgtcaaagacattgacatttgacgttgacaaaaacaatgtcaaagacattgggggatacaagagtgaatatggaaagcaatgtctttttcttacttggcccttaggctccagttaaggtagagagacaaaaacccatttaattattccatctctcactctattgcataatctcaatctattggaatgtaatccgtttagggattatatgttatagaacataatctacatgttagagtatacaatcccaattgatcctgcaaacatttctagaaaaaatcctatcaaatgagtaataaagtgttctaagcactaactagaaatgtattcaggtgaaaaagaaaaatccaaaaaaaagtgtttttttttattatggtttacttgagaatagaacttaagataggaacatttatcacagatttgactcttccataaaggattgatcaaagagcttaattctcagaaggtaacttaattcaccttgcgatgaggtcaacatgactatttacctcataagcaacttgaattttcatagtataattagccagtggtttttcaagtctaaagaacagcctttgccatgctaaaacatgatgaagcagtgactcactacagaagacaagccttttcagaatatactctgtgactcttttttttttattattatactttaagttttagggtacatgtgcacaatgtgcacgttagttacatatgtatacatgtgccatgctagtgtgctgcacccattaactcgtcatttagcattaggtatatctcctaaagctatccctcccccttccccccacaccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaagcacaggaactcatcattttttatggctgcatagtattccatggtgtatatgtgccacattttcttcatccagtctatcattgttggacatttgggttggttccaagtctttgctattgtgaatagtgctgcaataaacatacgtgtgcatgtgtctttatagcagcatgatttatagtcctttgggaatatacccagtaatgggatggctgggtcaaatggtatttctagttctagatccctgaggaatcgccacactgacttccacaagggttgaactagtttacagtcccaccaacagtgtaaaagtgttcctatttctccacatcttctccagcacctgttgtttcctgactttttaatgattgccattctaactggtgtgagatggtatctcattgtggttttgatttgcatttctctgatggccagtgatggtgagcattttctcatgtgttttttggctgcataaatatcttcttttgagaagtatctgttcatgtccttcgcccactttttgatggggttgtttttttcttgtaaatttgtttgagttcattgtatattctggatattagccctttgtcagatgagtaggttgcaaaaattttctcccattgtgtaggttgcctgttcactctgatggtagtttgttttgctgtgcagaagctttttagtttaattagatcccatttgtcaattttggcttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattatctttgaactgaaaattcacatcttaatttgcacagagtattctgaaatatcaaatgtatacctatattggaaactttaccaggtagcactgccacattcagtttttacataagaaactgagcattttagcatatgagttgggaagtcaattgtcctgcttgatttcctatttggcatgtctgtgataatattgaaattgcttaatgattttatttattccttggagaggtggatccgtacacaataagcatttgcaaacacctgggacaaagtatggacctctgtcagcatagtctgtttataggcctaggaaagtatgaacagagagttgagaaggaagaggcaaaggcatgttattttactgagacacaatgaaatggctgtacatagaaaatacatcttaagatatcagagataaaagctataaaaggggcaggaagaacaaaatgtaaaaattagatagtttcacttatttttcctttctacatccttttttttttttaattgggaatcttagattggtgggttttgggggagggtggagttccttttctgaggtcctttattttctgcttgagtgcctgaaaatagatgcaagacagagaatgtctccactgactctcacggtggctgtttattcagagtgcagccttcatttggctctcctggaagctggctgtgagacaaggaatccaggccaagttctttatttggcagggaagtggagatgtagatagaaaagaaaaggcaactaataacacattatcaagtcagttaccagtacaggtagctgtagcttaatcccactgggaaactgagaacccttagaaaagtttgccatcagcatcatcttctctggggcataagggatctggggttcttataccccttttccccaagtggtcatgatctctcttgtacttccagcctgtggtgttttcaggtgcacaggccgtggctgcgtgagaaaactctcagcccgttggaagtcaggagtgcaccacagtgaaaagggctatgggggcagagatggatagagcatgacagttctgctgtaagtggcccaagttgaagggagctgttctcccgtctgcctttttgccttcttataaaaaccaaattagcaaagacattgatacatagacttgtcttataaccaattatggacttatattaattacccatcaatattctctgatccatagtacatatggaaatgtgtgtgtgtgtgtgtgtgtgtgtgtgcgcgcgtatttgtaaaatgccattatccctggtattctatattagcctaagcttaaaattcagtccttgtactgttactttttactgtacatctgtgacaaaattaatactgccatatgatgggtgcctaacaccacccactgcttttaaattatattctcattttttgttattcaatgatggttcaactatttcaccaagaattaaatagaagtaagagtcaaaatgaccaggatattttctctaataccgctgtgtactattaaaaaaataattaagatttctttattcatatcaattatgagttgatgcactgaatgatgtaatatttattcatgttaacagtggaaaatgtgagtgggaacagctttcatatggaatgcttttcttgtactttagaagtaaataaataattaaataaataagagttctaatttatgggaaaattgtcttatatgagttgattttctaagcctttgttttaccagcctgaaagaggaatgctacacagtcatattttaatggctttgtttattcttttagaaaaagtatcaacatgacatcatctgaggctaggttgtgctgcatactaataaaaacctgagaaatgtatgtttgacttctgatgtaaaggttttctttttaatatagacttaataacaatttcatacttaaccgatgagagcagcaaattaatcaaacaaatcgaacattttcttctccagggaactggggaagcttctgatcccttgatatgattatatctatatatcaaattccatactaatgacccccaagagagatggctttatcaataagattgtaagttattaattaattaattagtctcctggaaattctactgtgtgattttctgtttttacctcacaggagggagttctgagttaccttgcttcttcagagggttagatttttcatgtttcagggttgaacaatgaggtgtaggcaagagctcaagatagcatttgaggggcttcgtttctgtattttagactattaagctaacttctataaagggaaagtactaacgttgatatttagagaaaaacacggggggagctaaaacaagacagagaaagacaatttgatgcccttaggatggggtgatgacaacaggtttgttccaacatagcagccatccacatagctgtaccagaagcaggaccttggcagggaagttctgtggccttgtgtgactttaaccctgggaacccggcaaagatttctgtaggcagagttgatacaaaagggaatgttctcaaagtagccaccactttaaatgaataaatagcacctcagtagaagaccactggccagtgttctgtccaaattcacacatggaggcaaaggtagccatacaaagtgatgaatactgagtttcttgctaatttcattgaatgggtagcttgaaacaattactttgatttagaaaaaataatgagatctgacatactttgcattgcgtcttcagtttttctgatcaatccgtaagttacatgatcttcacatacaaactaagaccattcacataaaagagagaaaaggagtaattatttttgctttcttagcaagtgcctagaatagcattttccggtgcatgcactggggacaatcagggccataaatttctgatatgaaatacatttaagaaataccaatatgagggcaatggaaatttccggtgcaagcactggggacaatcagggccataaatttctgatatgaaatacatttaagaaataccaatatgagggcaatggaaatttctttggtaatttgcaaaacatattaacatattaaaggttctgaagtaacccttgttactagtttaactttctttaacccagaattgcccaaacttacttgagcataaaagtgttttaacacttctgagaaatatcctttcagataccagatggctagataaaaataaatagttgttctacattgtaatagcatctattacagtttcaaatctaaatatctgtctttgttccaaaagcaagcttatgtatatgattgtttttattttctatgtagactcacaaaaggagagacatagaaaatttaactctacactatcattcccccagattcaactctggcatgataaagatcctagagtgtattacaaagaggtcacccttataatatggtaaatgcatatcttctgctataaatattttcataaagctcttctcttagtcaaggattgagagtacaactggccgtctttaggaaataggaatcaggaacgaatggttgttgctcaaaagcataacatttaagtgggttaacagagcacttatatgaatgagcaagaagataattgtgctattacacacagttttacgaccattaaaatacctgttctaatttggcatcagatacgtgagcacaatgtgaagagcctgaggttggaatgagagcaggaaaaatgtccgaagtttggacagggagcaaagaaattgagaaaattatagaattgaagagaaaaccatggtgaggcacaaaaaagctgtataattatatgaatgatattaggtggttggcaataagcaattattaatattttcttttatgagtgaggaaaaaaaaagtatggtcataacagagggaatgcaattcgagcataagaagaaacacgagagtattatgctgtagtagtccagtctcactctgctatgaagaaatacctatgactgggtaattcatacaggaaagaggcaaaactgactcacagttgagcatggctggggaggcctcaggaaacttgcaatcatggcggaaggcaaaggggaggcaaggcaccttcttcacaaggcggcaggaagaagtgaatgcaggaggaactaccaaacacaaaaccatcagatcttgtgagaactcactcactatcacaagaacagcatgggggaaaccacgcccatgattcaattacctccacctggtctctcccttgacaggtgaggattgtggggattacaattcaagatgagattttgggtggggacacagccaaactatatcacatgctaaagcagccaataatatctctaggaaaatgttgtagtttagggtagatatgtgtttggaacaatttagattcaaaactcacagaattgtgagtagcaacaatgattactcttaaattagtaatgctggaatataggtaattttaattgtgtgttctattctgtggtgccagtggcattttcccccctgatgttatttttctgcagctccggctttgtacataaatggataatagtgctccttggtgatctattttcaagtcaaaattctttcttattttctgctgaggtttagcattccgtggataaaaagcaaagtttttcattccacagcaaaatataatggttaaaataccaacagctttacaggaaagaggaccagcctaataaccctgaaatagtcgcagttagtgaacccttaggcacagttttctcagtaaaaaaataatgtgatagttgataggataacctggagaatcccactaagtgctgatgtatagacactgtttcaatcttctcacattcatctgacttccctccagcctacctcagtgctgtgttatcctgtgtatggacagattgcatgtcagattcctaattttcaaatcaattttcaaattaataatttaataataatgtcttatacttatgtatatttcaaatcaaccctggtaaatctgatacttgtgttttatagtcaaagttgagcattttatgaatgcaccttgtaaatatcacatatcaggcaagcactagaaaaccaaatcacaaactgaaccaggttatcttccaacatttgccaaaatgagatgcaacacatctgagggaaatatgtattaatctttcttgtaagttatctgaattggtttaatggaaataaaattttaaaaactaaaatatattataaattctcatggatctgtctacattggtttataatttattttttcattagatttataaaggggcaatgtaaaaattaacatcagaatatcttatataacccattttatccattgtaataaagtttattgaacacctgctatgtataacttttgttttatttccttttaaataatagaaactgtattaactattgggtttcacattttcctttggcttccatgaagctcctgcctaaattttttgctcaggcacagaaatgaatttatctaggttaactggataacagtgcatcgacctctattttacttatagtagaattttatctacatattatttcctgttctgttttatatacctttagcagtgtaagctaccttaagcctttgcagaaatcaaatgaactataagtcatatatgaataaataaatgctaggtctaatatagaaaaattaataccttgaaataaaggtttattgagtcttttttcagagaagaagcattcctctaatgaaaaatattaatcagaaccatatttgctaattaataatttaatgataatgtcttatgcttatgtacattaaatatatttatatataaatgataataataatgcctcacacttatgtacattaaatgcatataatatataattatatatctatattatcacttctcacagtgaccttaggaggtagacattttttctcaaattaagtgtgaaaaattagaattcacaaattccaggatttgaactaaagacaactaattctacataaagtggttcatctgtaaaatttagtgtttagaactaatgtttgctatttgcatagggctgcagtatgaaagagtgttgggaaatgtcattagcccgttcttgctttgctataaatatctgagactgtgtaatttataaagaaaataggtttaattggctcatggctctgcacgctgtacaagtacggtgctggcatctgctcagcttctggggaggcctcagggagcttttactcatggcagaaggcaaagcaggagcttgaacatcacatggaaagagtaagagtaagggagaatgtggtgggggagtgccacacttttaaacaaccagatctcatgagagttcactcagtattgccaagatagcaccaagcgggtaatgctaaacattcatgagaaaactacccacatgatccactcagctcccatcaggccccacctccaatactggggatgacaattcaacatgagatttaggcagtgacacatatccaaactacatcaggaggtaaggcatttagatatatgtgtagacttcaaacctccttgctgtctcttcagtcctctaaaatgaggtgtgtctaaagaaacaaaagctttcatacagacctgtaccctagtggagatactgagtcatgttgacaaggattaaactagtctatataggccatcacataaaaataagctttatttagccagacaacagtaaccattgtgttcacaagaacacatacatacaagcatggctgtttgctcatagtaaaattttctttcctctagccatcaaattatcttgaaaatttgctgaactcttcactgtactaacttaaaaagaccatgcaagacttataataactcattgcatgaagatgcctaagtcattaatgtgacattttttttagaaagacagccttccacaaatctatttctaaatattagaggaaattgtgaaatatggttcagatatgatagagaatcatagcccatagttttttcctggtgtaataagacttgtaacattttcaagaaatcaagtttaaagtcaatccataactctaagaagaatcctacagcctccctaaaatttgaaattatatatatacctatacacacacacacacaaacacacacgcacacacacaaacatatatatatgaaaagactctattaagataaaaatactacctagaagcctaatggggaaaatatggttaagtttgctcacactgaattggaacaaaataggattgaaattttattccaccatttaaaaagcatatgacttgggaaaattacataacttcttcacatgtcaatttcttgagctataaaaagagttcaataatataatttatctcatgaggttgttgtgaggattaattgtgataaggcatgtgaaatgtttcactcattgtttttgtaagtattgagtaaaatcactgaactggtgataaaataccaggtataaaactgacaatctatccaaattgatttttgtcttaacacattcagggcagaagaaaatgagaaaaaataaaacaggccgggcgccgtggctcacacctgtaatcccagcactttgggaggctgaggcgggctgatcaagaggtcaggagttctagaccagcctggccaacatggtgaaaccccgtctctactaaaatacaaaaatattagccagacgtggtggcttgtgcctgtagtcccagctactcgggaggctaaggcaggggaatcgcttgaacccaggaggcagaggttgcagtgagccgagattgtgccactgcactccagcctggcaacagagtgagactctgtctcaaaaaaaaaaaaggagagaaaaagaaaaaacaaaaccaaaccctaaaaacatggatacccaaatagagtaaattaagaatctagagacattagttatctgaaaactattcagaaactctgcacaaacttttgatattggattgattaactttgataatgaccttatttttggagtaaagtgaacacaaatatcagtgtattagcccatcctaaaatattatttcataaaaaattaattcatcataaaataacactacatatcaccctgctttcattttcttaactacattatagaatgatagcacatttagaagatgatgtcatctttcaattaataaagatagttgtgcctcttagagaaaggtaataatttcaagaagctggatgagctgcaaatctacacaaatatttttaagaacatatatctatttaacaattttgtgctctctcaattttatttttgctgtttttagacatatggatgtttctatttttgaaattctttcttgtttttgtttgtgatttctgttttttagtcttcctccaccaaagctgtttagtaatctagtttttttccatttcattatttgattagttatatttgattattaatctatcaaaaattacttcttcagttgtgcaacgtggcgatcaaaattgattctcaagtaaatacctcaggttcctagtaccaattattgtctcatcttaatatttattccttagtttattatttctcctttatttatattaattatttatgtattgtacaatataactcctacatatataacaggttatatttttgcattgccatttctggttgattggtctgtctattcgtaggttaataccagaccattttattgattttattcttacatttccagatcttctcttttgggcaatactttctgatttgaaaggaagtagtgaaaaagttttacaaaacagagaggaggaacatgtgttgatcagtcacatggtttgtaaagcaaaatattggggtttgttgtatagtgtttacttattttaaatattaattttttctattcaaagaaaatatttaatggtgaaaatcatgaattttggatatagatgtgggttcgaatttgaactttgtaacttaatggttttttaatctctggtaaaatccattaaattctttcaagctccttcctctctgaatgggattattaatatgaatctcatcagtttagaatgagtcctaagtgagattacagaggaataaataaagcacagcttacttgtgattgtaagttcctgtcttcttatattaataagaaaaataaaacgaaatagtgctaaagtgttgggacagcgaaaatttttggagatggtatggagagataatgggcgatgtttctcagggctgcttcgagcgggattaggggcggtgtgggaacctagagtgggagagattaagctgaaggaagattttgtggtaaggggtgatattgtggggttgttagaaggaacatttgtaatttagaattattggtgatggcctggatacggttttgtatgaattgaaaaactaaatggaataagagaaggagaaaaacaggtataaaaggtctaagaattgggacgactcaggacatctgattagagagtgcctaaggaggttcagcatagtcctgccagcaaagattatttatttacttcaagagttaagagtggcagtttggggatagcaccaggaggtatcagctttgatgacttggagaaacagtgtaaaccggcagtgtaaacaagagcagggcatgcatgagtagttgagaacggtgaataggagtatgactagacacaagatagtaggaatgacaagttttttgggggcacagtctaagttgatctggtgtctggaatgagactggggcctaataaaaaggagcgtctatacaggagctcaaatggcctgtaccttgtagcattctgaggacaggtctgacttctgagaagggtaagtggtaaaagtattgtccagtcctttttaagttggtggctgagcttggtgaggtgtgtttttaaaagacctttagtccattctacttttcctgaagacggaggaccataaaggatataaaggtttcactgaatactaagagcctgaaaaactgcttggctgatttgactaataaaggctggtctgttatcagactgtatagaggtgggaaggctaaactgaggagttatgtctgacagaagggaagaaatgactgcggtggccttctcagaccctgtaggaaaggactctacctatccagtgaaagtgtctacctaggctaagaggtattttagttatctgactcggggcatgttgagtaaagctaatttgccagtcctgggtgggggcaaatcctcgagcttgatgtgtagggaagggagggggcctgaataatccctgaggagtagtagaatagcagatggaacactgagaagttatttccttgaggatagatttccatgatggaaaggaaatgagagcttctaagaggcgggctagtggcttgtactatagcatagcctgcctttgcttgtgtgtggcgattaggcctggtggaactgccatcaataaatcaagcgtgatcagggtgaggaacaggaaagaaggaaatatggggaaatggggtgaatgtcaggtggatcagagagatacagtcatgggggtcaggtgtggtatcaggaataatgtgggaggccagattgaagtccgggccaggaacaatggtaattgtgggacttaacaaagagtgagtacagctgaaggagccagggagcagaaagtatatgcgtcagctatgaggaagaaaatagattttggaagttatgagaaatgtagagagtaagttgagcatagtttgtgattttgagggcctctaaaagtattagggcggcagcagccgctgcacgcagacatgacggctaggctaaaacagtaagatccagttgtttgcgcagaaaggctacagggtgcagtcctggctcttgtgtaagaattctgaccacactaaccatgcctaggaaggaaaggagttgttgttttgtaagggattgaggtttgggagattaatcggatacgatcagcaaggaaagcacgtgtgtttttatgagaattatgccgagataggtaacagatgaggatgaagtttgggcttgactgaagtaatgggggctgtctgtgaagccttgcggcagtacagcccaggtaatttgctgagcctaatgggtatcagggtcagtccaagtgaaagcgaagagaggctgggatgacgggtgcaaaggaatagtaaagaaagcatgtttgagatccagaacagaataatggattgtggagggaggtattgaggataggagagaggatagggtttggcaccatgaggtggataggcaaaacaatttggttgataaggcatagatcctgaactaacttgtaaggcttgtctggttttaggacaggtaaaatgggggaattgtaaggagagtttataggctttaaaaggccatgctgtagcaggcaagtgatagcaggctttaatcctttcaaagcatgctatgggatgtgatattggcattgagtggggtaagggtgattaggttttaatgagatggtaaggggtgcatgatcggtcgccaaggagggagtagaagtatcttatacttgtgggttaaggtggggtaatacaagaggaggacgcaaaggaggctttggattgggaagaagggcagcaatgagatgtagctgtaatccaggaatagtcagggaagcagacaatttagttaaagtgtctcggcctaataagggaactgggcaggtggggataactaaaaggagtgcttaaaagagtattgtctaagttggcatgagagtgggggttttaagaggtttagaagcctggccgtcaatacccacaacagttatggaggcaagggaaacaggcccttgaaaagaaggtaatgtggagtgggtagcctcagtattgattaagaaggggacagacttaccctccactgtgagagttacccgaagctcggcgtccctgatggtctagggggcttccgaggcgatccgacagcatcagtcttcagccgctaagccaagaagatctgggaaggagtcagagagccttcggccagagttccaggggctctgggagtggctgccaggtgagttggacagtccgatttctagtggtgtcctgcacagatgggactcggcttaggaggaatcctgggctgcaggcattccttggcctggtggccagatttctggcacttgtagcaagctcctgggggaggaggttctggaggaacgcctggtcgctgcgtttcagatgtttggaagttcttgtgtgctggagatgtggctggggtttgtctcacagtggaggcaaggaattgcaacttttttctattattgtacacgttgaaggcgaggttaattaaatcctgttgtggggtttgagggccagaatttaatttttggagttgtatttaatgtcgggagcagactgggtaataaaatgtattttgagaataagacggccttttgacctttcagggtctagggctgtaaagtgtctcagggttgctgccaaacgagccatgaactgggctggatttttcatatttgatgaaagagcctaaacgcacactgatttgggagaggtctgataaggaaaaaggagcattaaccttgactatgcctttagcttcagccacctttttaagagtaaattgctgagcaggtgccggagggctagaggtggaacgaaactgtaagccggaccgggtgtgaggaggggaggtgataaaaggattatagggtggaggagtggaggctgaggaagaattgggacctagctcagcctggccaggaggggagaggtagaaaaggaagattagaaagactcagcgaagcttggggttgggactgaggggacaggtgggagggaaagaaggaagatttgggatgagttacattgggaacagagactagagatgcactgacatgtaaaagagtgcctggacatcaggcacctcagaccatttgcccattttacgacaataattatttagatcttgcaggatggaaaaattgaaagtgccattttctggctatttggaactactgtcgagtttgtattggggtcaagtggcattgcagaagaaaataagacgcttagattttaggtcaggtgagaggtgaagaggttttaagttcttaataacacaggctaaaggagaagaaggaggaatggagggtggatggttgcccatagtgaaggaggctagcccagagaaaagagtagagacacggagaagggttgggggttcttgccctccagaaaagcagagaaggggttggggcacagagatacgaggtcagggcacggaaataagggatcggggtgcagagatataagaggttggggcacggaaataagggatcggggcacagagatataagaggctggggcacggaaataagggatcggggcacagagatataagaggctggggcatggaaataaggggtcggggcacagagatataagaggctggggcacggaaataagggatcagggcgcagagatataagaggtccgggtgcggaaataagggatcgaggcgcagagatatgaggttggagtatttgcccctcctctagaaaagcaggacttgccgctcagggtgaaggagaaggggttgggggtttcttgccccccagaaaggcggagaagacacggagagaaggggttggggtacttgccctttccccagaaaagtgggacttgccgctaagggtgaaggaccaaggcaggcatccctgcgtggtctgacacctctgaaacctgggtgaataatcagggacgcatccctggaatgattaaacaccaggggaaggctgccttccctagtccatgaccagcgccggagttttgggtccagggataaaacgtgtctcctttgtctctaccagaaaatgaaaggaattgaaattaaaagaagggagagattgacgtgtggcgccaagattgaaaggagaaagaggttgagggatggtgagggaggttggagaagagagtaaaaaggggctgcttaccggattttaaattggtgagatgtttactgggctggtcggtctgaggacctgaggtcgtacgtggatctttctcacgagcaaagaacaggaggacaggggattgatctcccaagggaagtcccctgatccgagtcacggcaccaaatttcatgcgcctccgtgtgaagagaccaccaaacaggctttgtgtgagcaataaaagcttttaatcacctgggtgcaggcaggctgagtccgaaaagagagtcagtgaagggagaaaggggtggggccgttttacaggatttgggtaggtaaaggaaaattacagtcaaagggagggttgttccctggcggtcagagtgggggtcacaaggtactcagtgggggagcttttgagccaggatgagccaggagaaggaatttcacaaaacaatgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacagtaagtgttcagtaaatgtaattagtataattattaaaatattcatgattattattcctttaaaatattctagaaatcttcatgttatctaatctggaaaagaatttttctagctccattgctaaaaaaattcttcaaattcaaatttatttctgtatctcttaatagaaatgaggaaacgtatttcctcttcctgtaatagtagtctcagaacacgtgactgtcacttgtgtgtctctgtgagtgactgtgtggaaagaacttatctgactcactcacttctctgtgccttggctttgggtatatggctgcaagtctctgctaattactcctatgccactttcagcacaaatatcacttattatgtgctgcttgaatattattttctttatttctaagtttggtccattcagtcctctcatggcatgagttgcttttcttatttccacataagtatttgaaaacttgtcagaatgctattttcattagacacttttcattattacgctgtcatcactgaacaagtttatttcaaagccttttgagaaaaatgacagaaaacatagcattttatttccttggccgttcattagattagaaatgtcaagaaagacttagattatacttatttttattaaaaggaatgagagacttttcttgaaaaaaagaaaaaaagaaatttaaattttgaatgctacgtcttagggctctatgcagtgaaacattttctcttcattgtttagaaagacttacattttattttaaaattcctgcccgtctttttctcttgaagagataagatactctaatcattctagaacaccagctattaatctgaaattaaatctattacgtgccagaaacaaattaccccaaagttaacctaaaatatcatcagggtaacaccttcagttacaaattatagtaacatcttagataataaatttcagcagctattaaaagagagatgataatagtacctttgtctgaggcttcttatgataattgactttaaatatgtagagcatctaatactgcatgtgaggctgaattctatgaaattactaatactgaagcatttttggcctacagaaggaacggtttcatgtggttcaaccgaagtgttgctcgttaattttgagtttcccattcaccactgcactgacctttagccaggacagtacttactaattataatttaaaggtcgcatggatagagagcaaggcagacttgttacgacaaacctgtgtcttgtctatcttggtatggtggtgcctcagttagcacagggctttcactctcttactatggccagcttcacagtctctgtgacccttcaacctgtcccatgacttctgcttacccgtggccatggtgtctactgatggcatcactatgctcactgccttcacccatatgattctcatatgtgtaatttactagccagtatccagcaaggcctgctgtgtatgggagctggtgccatagaaagtgtggatgaggttatgtgtaggtatctctgctggtggtgggttgatgataaccatatttgacgcccttaaatttctaaaattaggagtcattgtattcattctagattgaggaggatagcatttaaatggggcttaagtatgccttgtaagtatgtaaaaagatataaaattaccatgcatactgtctttcaataacataacaagactgtagtttagtgagctcaaggtgacaaaatagccattattttcttactgtgagagtcattttgtttattgtttgcatgagtgacaatttttccaatgaaactttcttggttaatagaccctttcttatacataaatatgaaataagagggtgatagaaatcagatattatatctagtttttatgactagcagattacacagaataaaaacatcacaatgacacaaaacataatcttacacattagacaaaggcatacaactttaaaaaatattgcaatcaaaaagatgtaattaaattaccctgattcattgaaactttagcttttaaaaggttcatttttgtgggtataaataaattttgttatcttaattttatacaagttacaattatattattgttaatgacagataccaaatttaataatgtcaccttgttttatgttttataaaatttgcttcatttttccacctaagcagatatgctgtcaaaatgtggtgttacctgaaattttaaaatgcatctcttttccttgtgtaattttataataaaatagttaagaatgaagaattataaaaaagttaagaattttattttgaagactgatattctaagttgcatatagcaaagaagttacgaacttttatagtcaaggacctcataacacatgatagatgctaattttaattaaatttattatttcaactttgaaaaatggggtaggaggagagtatgaatcagaggatgaagtaactcacaatttaggctataggggccacatttttctaacttaatattccatgattatttccaaaggttacttaaatccaatatatgactcagagcttcagacttaacgtcatacattttcacataggttttaatttgtggagaaaggacatattctgatattattatagaaaagccattggattctatggtgtgataataagagatttcaggtctgggtcttctttatcagtcagcttttgtattgcaataacctacaatctcaattctcaaaggcttagagcaagatcatttgctttttgttcatctgaggactgccgggtgagtttgggttggctgggctcagtttcactgggcttttgattccaggagcccagagtgaagcagcagccactatcctgcagttttcaacgcagaggacataccaggggagacagaggctgagccaaatcaaataatcacattgaaaccttttgcttaatcataccaatgtcatggctgctcatattcattagccaaagcagccacatgacttggcagaagttcatagggttctgatgcttattcctcccatagaatgaacaggaattctcatataactataattgactatatcaaatcccattgctggaagtgggtgaatagctgggaatagtaatccactgtattacatatgccaccaaatgattcagcaactttccagtttcctactggacagagagaggcctgtctctctggaaagtcgctcctcctttatatgaccgccctgacagaccttgcacttgcaacttgactccctgctgaaaaccacttctactctgttttcggaaatacctgtagtgtcagtagacaaagtagaacaaaatgagaaaatagagagaggatgggatctgaaaactagtataagtcagggcaggaaaaaaggaagagtctgaaagcaagcttggagagctgactcttagaccagaatagaaaacattttcttcaaaatattcgccccttttcaaatgcagaattaggccagttatgttttaggatacccattgccttatattcttaaaaagaaaagaaaaagaaggaaaagaaagagataacacttaatagtccataacaaagtgtcaacgggatagacacatgcttattcaaaccacagatatgatccagttaatttccttcttaaaatgtgcccatagtgtcttattgcctcatcgtaatgataataatgagagcaacaattataatggcaaaagcaaggactcctgccatttactgtttgtgtattaaatgctccactctacactaaaagctttatgtacagtcttattcctcaaaataaatatgagaaaaacaactttaccaaactcacatagttaataaaagtatttttatgagccaccacaatactcaaaaatggtgcaatactgtgttttcatgaatttcacccaatctagctttcctgactcatctcttgccttcccctctgtgattgctaagtacagacacacagaagtgctgccatttcctcactatactctactatttcacgcctctgtgagtctgtatccatgaatttctccacttggaatggcttttctagccacactactcctttgccaacctaacaaattctgtttctcttctaatgactcttctagacgcagtcctctgccacctgctctaggaaggtatgccataggtagataagttgtctcctgcatttgcttgcagtctccacacactgcagcgatcacatacacctgcacataaaatgtctttgctatacatgcccattcctgggcccacacaagtcttccacccttcctcaggtgtgaataccttaagggtcttctttattcctattttattttatattccagtgtatgttctaacaagtaatcaagtgacttgaatggaaatctcaatagccaaactgagttgttgctgtacatttttaatatttaacagagagatggatctattggaggcagtcatctgagatgatcagatataatggccaatagcaactatgctaatcataaaatttaaaatgtaaaaaattgcttcgtcaaactgttttaaaagatgtatctaaaacatagtaggctgagcatggtgactcatgcctttaatcctagcacattgggaggccaaggtagcaggattgcttgaacctaggagtttgagatgagcctgagaaacatagtgcaaccctgtcactacaaaaaaaaaaaattaaaaattagctccatgtggtggcatgcacctgtagtcccagctatttgggaggctgacatgggaggatttcttgagcccaggaagtcgaggctgcagtgagctgtgatcatgccactgaactccagcctgggtgacagaacaagacactgactcataacaaaacagaacaaaacaaaaagcaaagtcaagatttggatgttcagtgtattcattgctacttgcacacacacacacacacacacacacacacacacaagcaaacacacacaatatagttttatcagaatacacatattctgatagcagaattgaaagcttacataactgtgcaagctttggattctgctattctctggtttactcatccccagttttccaatccatcaataaggatagcctcaattatctaataagcatttcatgtgtatttcaataaaataatgcattttaatgaaaaattcttagaatagttcttggcacatgccatatttaaatgtcgccactgcctcattcatacagatcgtacccaagtaaaagtgtatatatggagaataaaaatgaaaacaggaagtaagacagtaaatggaggaagtcatttagatttgatagcatggtttccaaaggcagtgtcctattagaagtgttcaggtaaataaaacgttattggcagagacagatggtaaagccattttagaaataaaaattaaccaggtaagcacatgccaattttgggaaaacaatttattgtacctttttttctggagcttatttcaatgtaaaagtactttaaaaacttagaaaatagggtacatattaggtaaaagagagtcttgcaaaaatggatccagcaaatattagtgaagagaaaaagatgatcagaactctgagtttcagtgatttgtcttgtaccatattcaagctgtaatcactgaaggtaggaaacaaaccagcaaaacatttgtaaggtgatggtatcatttaaaaaaaatagagaaacattacagacaacttaaattggaaacaaattggaaacaatttttaaagttatataaacaccacatttcaaaaggattgcatgatatcagaatgggaatttctagtagaaagttgaaaaaaaaaatgagactcaagggagactgttagtgtggtggtaagattgggtagaataattcagatctcaaccatgggaataacctgttgaataatcatgtgaatactaacaggtcacaataatcccgtgaatgaacatgttgaatttcggcatagagagacagcattgttattgccaaaagagctgagtagaaaggaattttgtgatgagtgatttcaagctacatttctctgagtatcaatgtgcccatctggaaaatgcaacaataaacagccctcacataattgtgaatattaaaagattatttgaagtgtctaccactttgctgatagggattcaacaaaattaaatttttcataccgaagagtagaattttccgtcagtacctcatggggcatcaacaatgatgataagcagtagaggctgacttgatattagataacattaggtgaccagtgagccaagacattcacttctttggctttccttcagtaaagtaagttacctaaaatctgaattagagtaagcagatgttgacagggataaatgaataggaaaagcatgcagagagttaagaaagaaggcatctaggatatttgtcaagaaggattaaaggcaggttttatgtatgcaaacctggatggtgaaaatggatagtttactgtgctgacttcgttcagaggtggtataattagacagagagacaaagccgcaaatgtgacttaacttgggcacagactatgagatagttggcatttgtagctggaaagtgtaagggccggttccagaggtttgcactgtagcagtccattgtgatgacaagatcctggaattcatcatgagacagagtgaattatgtggagaaggaaagtgaaaacaagaaggatgaacccagtctggtggaatttatgtcttcctcccttctaaattttgactgtgaataaatcttgttgcaaaagaaaaggtcattattaatagcatcagtcatggatgaaaacaaattagaaaacttgtttgttttattgaacatgattcagcagcagaggtgatttgaaatatcctatagggaaggaattcatgcatgcataaagtgtgttggggcaaaccctactggaagcttctttgggtcataggtcttcctggccttttcatttgtgcagcctcttggcaggtcatcactactttctaattctaagtcctgaaaattgcctatgaggtaagtttctatttcattaaatgttctattaagacaagttttctattgtcagttttgttatgaccaaattcataaatggaacatataataaaatgttaggaaatttggacattttatttcatgattattgatttctaaatttatgtaaggtccattctgtgaaattcctagagaaatttaaagagttttctttagaatattttatttgcagttattgatacatgtaacaaaaatatgggtagtatttttgctttctatgacaaaatatttatagttaagatattaaaaatataacgaatattaattatacaaaaataatacattttagaatgataattcaaatacagaacccatcaaaatcaataactatatgttagtatcaataaaatgccaattaaaaatataagaaaatatgagaaaatactaagaaaatataagaaaataatttaagaaaacctcttaagagatagcttaagaaactttcttttacccataaaatcccatgccttaccacaacacggcaatgcagatatttccttcaattactggtgggaaaaaaaaacatgagatttgaaatatcaaataaaatgtgtaaaatcaaaaaaataaacagtaagctaaaacttggaggtttttattttttccctactacatctctaaggcgttgtgagattcatttaagctagaacaagtagaatgtgttctagaaatggcatccataggatagtttaataaccggaaaacaattatccacaatgtttcaaagcatacatttggtttgtttgtttttagcattttaatttgtaggttcattcaagttaccacatccaccaattaattgcaaaagacctagccacaggcaatagttgactacttttgctttcctttatttgaacaactgttattatgcagatttcttgttagaattattctgctgtaagagagtgaagtctacctaatttcatgaatataaagggggagatgaattatgagaaatatacaggagtactccatgaaacccagcaacaaaaagtacaactggaaattacaaccagagccagaagcaagagtggtataggaagaaagatggctacttcttacatctctgcctctttttcttatctttctatatatctgctctgtttccctttctgtgtcagtaaggcaataccttctgctgtttacaaggccccaaaatgactgttttacttatacctaggtgtacttgactttccattttcaaaaactatcacgtacttccagatgtaaaaggattatgtctcttggattaaattctagaggaataaaatgggattggcccaggtgttctaatggacagtatttctttctgtgagaatgaagggaagagacagcagaatatgaacatggaagccctggcccaatactttagcctaagccagtggttttcaaacttgagtccccatcagaatcactgggaggctgtgttaagacacagattgccagcaagttttcaggtgataataaggtcactggaccagagaacatactttgaaaatcactagttatgctgtgggattgtaacagttctcaacaagaggaaatggacaaatattccaacgatgtgctatctgtacctttttgtgcaattgagccgctttgattatccagcaatttttttttttttggagacgtggtcttgctctgtcacccagactggagtgcagtggtgtgatctcggcctcagctcactgcagcctccacctcctgggttcaagcgattctcctgtctcagcttcccaagtagctgggattataggtgtgcaccaccattgcctgactaatttttgtattttcagtagagacagggtttcactatgttggccatgctgatctcgaactcctgacctcaagtgatccacctgcctcgcccttccagagtgctgagattacaggcgtgggccaccatacctggtctatccagctatttgtcttcattcatttattaaagaattattgagaagttactatataagaaaatagacatttatattcctatatatacaaaaattaattccttaataaatatagttcatgtatgtgcctggatactaagcctcacagcacatattattatacattttttaatatgtaataccattttactattttattatctaagtacagaacaatcaaattttcagaaaatgcaatcatttatattttatgctttatttattttcccaaatatttatgcataccatatgtgttatattgtaaataaaaacaaaacaagtgaaatagcttgttgatgttggaggttctcttatttacaataatttttcttcatgaagaaagatgtgtacccatatagtgatggatcaaatataaagtttacttgttaccatatattaagggtcaaaatatcctgagaggaataaactctctaaactgtttcttctgaaacctggttccacagtaacatagtctcctgatttacgaatataaagccaatcaatcctcagagatgagccattcttttcgtcactgctactctcttttgaagtgacattttcctagctgcataatctgagataatgtttggttgtataaaatatgctactattatcacatgtatgtgctgaaaaattacaaataagccatgtttcttaattatgttatcatactgagtgatatggtttggctctgtgtccctacccaagtctcatgtcaagttgtaatcgcgaagtgttgagggagagacctggtgggaggttattggatcttggaggtggtttcccccatgctgctctcatgatagtgagggagttctcatgaaatctgatggtttaaaagtggaagtttcccctgcacgctgtctctctcctgccaccttgtaagaatgtgcttgcttatccttcaccttttactgtgattgtaagtttcctgaggcctccccaatcatgcataactgtgagtcaattagacctctttcctttataaatttaccactctcaggtagtatctttatagcagtgtgagaattgattaatacagagaattggtaccgagagtggggtactgctttaaagataacctgaaaatgtggaagtaactttggaactgggtaacaggcagagattggaacagtttggagggctctgaagaaggcaggaagatgtggggaaggtcagaatttcctagaggtatgttgaatggtgttgaccaaaatgctatagtgatatggacaattaagtccaggccttggtagtcacagatgcagatgaggaacttcgtgagaactggagtaaaggtcacttatgctgtgctttagcaaaaagcctggcagcattttgcccctgccctagagctctgtggaacttcaaacttaggagagatgatttagggtatctggtggaagaaatttctaagcaacaaagcattgaagacgtgacctggctgagtctgaaagcattcagtcatatgcattcacaaagagattacctaaaactgatacttatattttaaaggaaagcagagcataaaagtttggaaaatttgcagcgtgaccatgtagaaaagaaaaacctattttcttgggagaaattcaagccagctgctgaaatttatgttaagtaatgaggagctgaatgttaatagccaagagaatgaggaaaatgtctccaggccacatcagagatcttgacagcagcccctcccatcacagacctgtagtcctaggagggaaaaatagtttcctgggccaagcccagggcgatgctgttctgtgtaacctcgggacttggtgccctgtgtcccagccactctagcttttgctgtggctaaaaggaggccaaggagcagcttgagccattgcttcagagggtgcaagccccaagccttggcagcttccacatgtgttgggcctgagggtgcatagaagacaagagttgagttttaggagcctccacctagatttcagaggacataaggaaacatctggatgtccaggcagaaatttacttcatgggcagagccctcatggagaacctcaattagggcaatgcagaggggaaatgtggggttggagcctgaacacagagtccccacctggggcactgcctagtggagctgtgagaaaaaggccactgtcctccagaccctgaaacagtagatccacagacagcttggattttgtgcttggaaaagttgcaggcactcaatgccagcccatgaaagtagccatgggggctgtatcctgcagagccacagaggtagagctgttcaaggccttgggagcctcccctccttgcatcagcatgctctggatgtgagacatggagtcaaaagagattattttgaagctataagatttaatggccagcctgctggaattggacttgaatggggcctgtagcccctttgttttcatctatttctccgttttggaatgagagcatttgtcccgtgcctgcacccccactctatcttggaattagctaacttgttttttattttaaaggcttatagaaggaagggacttaccttgtctaagatgagactttggactttaacttttgggttaatcctggaattagttaatactttaggggactgttgagaaggcatgactggtttcgaagtgtgaaaaggacatgacatttggaaggtggcagaggtggaataatatggttgggctctgtgttcccacccaaatctcatctcaaattgtaatccccacgttttgagggagagacttggtgagaggtgattggttcatggcagtggtttctcccaggctgttcttgagatagtgaaggagttctcacaggatataattgtttaaaagggctagtttcctctgcacactctttctcctgccaccatgtcagacgtgccttgcttcccctttgccttctgccatgattgtaagtttcctgaggcctccccagccacatggaactgtgagtcaattaaacctcttttgtttgtaaattacccagtgtcaggtagtatctttatagcagtgtgagaatggaataatacacttagttactgagattaatattcaaaaaattaataacattttattgataagaatcacaatgttatgtgaaaagttcccacaatttttctatgtgtaactcaattagaactagccccttctgcttgcctgctctcatttaagtcatctctcaactcccaactatatcccaaatacacatgcaattataataaataatatagaatttatagttttatgaagagataaaaatgagagggagggcacaccaaaaaatcacacaattatgcttcttaaatttccctattacctatatgcagtaattattaaaatttcctttcccaaactagctactacatcactctactcaaatcttctaaaaatttctagggtatcggtttctttttctcctcaacagaaagtctcaaaattctgataactcatatattgtagtctgcaaaggttgtagctgaacagttttagaaattcagtctttagctcagaactattctgctgagggagactaaatttattttcttccaaataaaataaatattatgtctctatttgaaaatgtatcctgtaatacctagacatgttttttcatagaaggttttgaatattttatgtttgaaaggcattgaaaccaatgattctatggataggaagaaatgaaattaaactgactaatgaacaagcacctctgaaaaatttcaagaataatttttaaatattcgactgcattgattgttagaaacatgctcagtgtgtgtgttgctgtttcttttattgttctgcttggaaagcgtgaaggacccagaagggtgataattttccacactggtcctctcctgtccctgccactcagccatttcatttcaacccctttagcacatgaccttagccactaacttctttttcaccagtcatgataaactcaaactagtggatctaattagctattagcacagctaataatcgtgagaacaaactttgtctcttccatgcattttaaaccataattcctaaaatgatcagaacttcagctgacccccttggtaaccatcactaaaatccttgcccccctcaattgcacgttagacaactcctttggtctttacttatctgacattttttcaaaatggcctatagtatcagtgctctggataatttccttcccctagatggttccaggaaatccagttgagcaaagtcatacttttgtatgccttttaagatacagaaagaaatatttcttctcttccaatgcatataacatttttccaatatgtacaaatcaaaatttctattggtaataaaaaacaagcaaccaactaccaagcaagaaaatattacatcagcaattgtttttatgataaattttgccaaataacaaatagatttcttgatggcagctactactgaaaaagcttcatatttaatcaaagtttagtaacagtgtgaaaatgaggggaagttggggttaaggatgatgtcattgttttagtcgctgtgataaaaaataatagacatctaattttggcattgtttaaaaaatatgattttacatttagaaatacttagttttaggtaggaacaaggcatgtgcttacaaatatgcagaaagtaattgggaatatatataagaatcaccttaactatctgatccttaaaaccttaataacaattgtgccaggcaaggtgtgagagccctggcatcacaaagtggtgggcttgtgggtagtggggtagtaagaagaacttaccaacaacattatagttttgaaagggaaagttttggccaggcgtggtggctcatgcatgtaatcccagcactttgggaggatgaggcggacaaatcatgaggtcaggagttcaaggccagcctggccaatatggtgaaaccctgtctctaccaaagatacaaaaaaattagccgggcttggtgacgtgcgcctgtgatcccagctaattgagaggctgaggcaagagaatcccttgaaggaaaggagggagggagtgagcgagggagggagggaggaaggaaggaaggaaggaaggacggaaggaaggaaataaaaagcctcatgtttaaaatgattcttcgctctcttctgacttgtaaatctccctttctcccttactcttaagcgtagttccatttcattgtcttctcttcttcaattctaacctctctggagaaatatgaaagaaaatcgtagaaaaatataatcttgggtttttttatcagagtaattcagctttttctaacctcatgggcagattaggccttacattttcaagtaaaactttgaaatgataatttgtaaaggcctgtccgattaactatttagataaaaatttacctcttgtagcttcctagaggttgtagacagagcagggtatggttggcttcatttttctcacttacaagtagagaacggaaaatctggaatgagatcagggataccatatgggattggaaatcacctgtgaaataatatttgtaaagccaattaaagagagtcaaagacagacctctaagtgcaagtataaagggaaaatagaaacatctcaatgttcacccatttaagggacagggaaatacattaaatccagataaattacctgagaggtaatcataatagttgtgtgagttagtgcaattatcttaatttacttatagagaaagtgagatacagaaatgaacggagctaaatgaagaagtcattatcaaatgtctttgacttaaagactgtgtcctttttaggacagtaggacctccctaatgaatttattctccttcgcagggtcagaattgagaataagtaagttagaaagtgatttcactttggtagattccaatgctgtcagtcaacaagagaagaataaaaacattgccctgtagaaaagcaatctatccaggccaggaggggtggctcatgcctgtaatcccagcactttgggaggccgaggtgggcagatcacctgaggtcaggagtttgaaaccagtctggccaacgtgatgaaaccccatctctactaaaaaatacaaaaactaaaaattagctgggcgtggtggcgggcgcctgtaatcccagctcctcagaggctgagacaggagagtcgcttgaaccaaggaggcagaggttgcagtgagccgagatcatgccactgcactccagcctgggcaatacagtgagactccatctgaaaaataaaaaaaaaagaaagaaagaaagaaagaaaagaaaagtaatctatccagtaaattgagtaacttaatatgtttttattattctttccattagtctaataaatagttggcaagaatgatggtgggagcaatccaaacgttgacaatgaaaacagagacatgaggaaacagaaatagcacgtggggttatctgatggtagggaagaaagcctgaaataatagggtaaagtgcaagtgaagcgaggaagcgagaaaaaacgaagcagaaggagttgaaatgccagaggtgtcagttactaacaacacatttaatgtgagagaggcagatcgttgtggaagctagaggtgatagccattcaaagcagatagggggatcgcagcctatgatgctccaaatgctactgccaaatgacagccactggaaatgccactctggtcattgtatcataagatgttaaaggtttgccattcattagtttcaaaggaatctgaatgagtaaccacattcattatagagacaaacaacagattatgaatgtgtactttaatactttaggggctgaaaggagaaaaaaacaaagacaataaaattctaatggctgtatttaaaagtgaacattgtgtgagtctaagaaagctaacagttcacagttcagtttgtcttaaaaaatatgtgtgtctgtgtataacgctcgtattacatatatctcatattaccatgttatataactatcatacataataccattatgacataataccattatgtatgtatgtactatagattattaccattatgtatggttatttacattatacattatatgccatttaataacatttaaagtgttataaagatgcaattttaaattacaagtggatttgtgacaagataattgaatccacaatttatgtcaacagagttggaaattgttgaggcatgtttctaaacttttaaaataggtcttcatttgagtagattttctttttttttctttctttcttttttttttttttccttgagacagggtttcactcccgtcatccagactggagtgcagtggtgtgatctcagctcgctacaacttctgcctcctgggctcaagtgattctcatgcctcagcctcctgagtagctgggattacaggcatgcaccacagtgcccagctaatttttgtatttttttatagagacggggttttgccatgttggccaggctgatctcaaactcttgagcttaagtgattcacctaccttggcctcccaaaatgctatgattataggcatgagccactgcgcctgtgctgagtatattttcaaatgtagaatactgaattcagtgcaatttgatcatattttgaaaatttctgcattattatgttgttgtattggaacatttgggttttcgtagttgttttgttttgtgtccctaaggggagatgaaccttctttgtttgcttgaagaatacataacatatgggtcttggtggttgagaagaccatggaagcctaaaagaacaaatttgccctctcccagcctcgcttgcaattagctattaaagttctatgggtgatacacatattatcaaagtttactgttagggaaagccagagcataagccataatcacatgacttcagctgagccaattgtaagcaccagactgagaacaaataatgcaaggagagaagattagcaaaggctccctttgggacctggcagttcacagtgatacttagagacaaaggcaatgtaagctgaagcagctagtactgagaaaaagtagcattattgtcttcactagacagtgaagtgtggagtggtttttgactttgatcctgagtgtctagccttccattgttgcttctggttttctgagccagtgtttgaaagcatcccacagttctatatgctaacacaattaactcttaaaaaattctgtttttctttaaatcccccagagttagcttctgttgccttcaactaaaaaccttgacaagtacagtagataaggcatggtttgggatcacaacttgattttttttattttgggaatacaaatttaacttgtggagagactgatgttctctatctcaccaaaaattgtttttgttataagctgtattcataagtgagctgtaatgttaaagagaaaaaagaaaaggattttaaattgctttctgcagcagaatgggaggcagtaaaaaggacaaactgctaaacagagaaaacaagacaatagaaaggaaagactgttctaaggaggagctgacagggctgctatgaaagaaatgtagagtctggctttaaattgcacatgtgacaagaaagatgtgatggaaaaaaaaatgtttgtttactcacactccgtccacatcctcactgcaacacacccacagcacactcttctaaggaaggttcacattgctgaattttttttttttttttttttagttgggtgtatagctgccttcaataaaatatttagtcacatacttgaacacagtgtgaagtcataggtatttgtgtatcacgacaacagcagataggtatttcaatatcaaaacaaaattggagaaacctgtgtagttgtaaaaaacactgcataaaataaagggagattgaggatgggtggtagagaggaggcaaatatcaggaaagaagggaagatgtccatgtctgatacggattttctcagctgtaaatgctgaggactgtttagtaaccctctttttatgtgctcatcaaatggacattaaaatatctatttgtcatagtggtttgtgagatatattcatatagcaattaatactgtgaagcgctgaaacttgctctaagttatacaaagagtggagacagagatagccaattggaagccggttacatctaggccatgtgttatttctgtatttacgtagtcttctctgtgtaattagaactgctataggtgctaattgaaggagaactttagatcctagatattataaaaaataaatagaaaataccattgctatggactgaatgtttgtgtccccaacatttatatcttgaaatttaaaccccaaggtgatgataataggaggtggagctattgggaggtgattagttcatggagttagtgcccttgttaaagaagccccagggaactgcgttggccttttcaccacgtgaggacacagggtgaaagcgccagctaatgatgaatcagaaagacttcatcagacactgaatctgtggatgccttgaacttggactttccagtctccagaactgtgagatgcacattcccgtggtttgcaaggcactgagtctacagtattttgttatagtagcactaatggactaagattactatgggggcataaatcctctaaaccagattttctatagatataaaaattaaaaagagctatgatacaaagagtccccatttgctctatatcccatgatttattcatttgatcaataaacatatgtgcagggatctaggtataacaacatgagaaagcaacaatcctcgtggaaatggtggaagcaagagaaattagaatttataaatgtgtagtggtcatacatggacttcataataatctagtgaaaaacaccacatgatttgttcttaatcatgttaatattataacttcttcagagctctcgctaaacacagcagcaagaaaatcagcctcaatcaactttgggagaacttttaactttgcctagtgtcagtcgaatgaatatccaggaagctcatgttatactcagaaaacaggaaagctctgaccattagtctgtggtgtttatcgtagttacctttgctctttctactataaggtggtgctgaatcttgtcctctgccctctattgaaaccctgaccctccacgcagaaatctttagaaccacagtttaatggctatcttttatggtcatcctatagtcagttaactaaccaattggaggtgccacaagtggaccaaataaatcttcatgttgcaaaggaattaaaaaacaaaacagtacctggacccagccctaagtaggagaggcatgactccatctcccctctggctgaataaccatccatcttataactccctgcctttcagagttcttttgtttacttctatctggatctgcttttccatctccaccaccaaaacagctcctgagtagagtggtctgtttttcaaacttgcaacctaaagacacccaaatgaaaagaggaaaatgaaagaataattcatttagttttttcttggaatagaattaagggaaaaatagctcacattctttcaagagggaacaaaaggtaaattaatattttaccatgttatccagtagcatatccattatttacgtggtcttattttattgattggtcaaaagattcacaagaagaagatagttcaacatacacctgtgttttgagggtgaaactcagctgaaatacactggaaacaatagctgtgaaagtctacaaggcaatgggagtgaaaagcataatttaaaaccatcatctttacctaatgatcaaagcctttggcctctaacagagattcttcatagcagttcacaaaagagtgccatactggggacataagagggtgggccaggtggggtggctcacgcctgtaatcccagaactttgggaggctgaggtgggcaggtcacgaggtcaggagatcgagacaatcctggccaacatggtcaaaccccgtctctactaaaatacaaaaaattggccaggcacggtggcacgcgcctgtggtcccaggcacttgggaggctgaggcaggggaatcgcttgaacctgggaggtggaggttgcagtgagctgagatggcgccactgcattccagcctggtgacagagcgagactccatctcaaatcaatcaatcaatcaatcaatcaatcaattagggtgtaatgggagagttaggaagggatcctatcctacagatggggtaaaggaaatgttatgtaaggtggcattggtaccacctattgattatgctaactgatgcattccaagttaccaaattagatctcttataaacttgaaattttatgattaagtattgctagttttggtttggaaaaatgatccaaaatttatgttgcataacttatagttaaaggaaaatgtagtacaatgatactgtattttactgttgaagtctttgtgttgggattaagtattaagaagaaaattactgttcaacataacaaccgaaagggtaaacatatttaaataattacttaaacaaatgtaaacattattaattccaactaactctgtatacactttccagcggttgcactgccttgttcagatagctgttgcttcatgtgtggcatggccaattggcttcatattatgaaggatgagaggcaacctgaactggccaaccatgacagcagacctttcttagggaagtcaagtccatcattgcctttttcactcttcagtttcaaatattgtaagatcttttatatgctgctgtctttgttaaacatgggaggctcaaacatgtcatcactcaggacttcatacctgattcctctttcagtgtttatggctactgtcttaccccaggctttcattttactcttattgggaccatttcaagggtcttctaactggactttctcccattactcactccatcctccacattttcacgatggttatttttaaattaggagtctaatcatgttgttcgtctgccccactgcctacagcgtaaactatagtttatgtatagaattttgtatagaattcttttgtatagaattcaagaccctccatattcaaccattaatgattcttgtccgtaagcacttagcacagtgctcaacgtatggcagacactgagtagataaatgtgtgctaggtaaaatgaattaagggcaattgagtggcccttccaccagatgatgtcctggtgtctagaaatagatgaattttgattgtttttggcaattatcttaaagatttcatatccagaaacttcaatttcataatttttctgattagcccattccattttattcagttgctttgatgataatcaataatagtaatattgttgacttcatacagaagaaaagaagataacttttaaacaattttaatatttccaaaagatgttttatgatcattttttacataaatattatattctttgaatagattatctgaaatagaattccaggaccaaagattatctaccactttaagccttagattgtaaaatggtctcttaaaaaagcacatcagctcagacccagatttataatgttctgactaaattataacattttatttaattgtcgataaaaagcacactgtttcacacataacacaaatttaactttttaaatttaaataccttaaagggtcaattattgcaaaagacagattgagacattcaacaaacatttcttgaatacctaatatgtacaagaccccatcccagaaaactatatagagttatagaaattaaattaagtgaaaaaatgagtatgtaaacatcaaaataaaaaagttagtttggagtcaaatgtaagcatttgttcttaaaaatattatggtttcctccaggattattctttagtagtacttgccaattttttctcagaatgtgttgtcctatggtttgctttttttaatttcacaaatgtcagaggtacaaaagagtcttacaccttttcttgcaggatttctaaaaatcgtatttagtcatcaagaccaaatttatcatcaaaccttaacccctgaaaccaagaaatttatgtatacattttatttatattttcatttatatttacatctcagcagtggcaaatgatacttatatggttttatgtattttgtacagaatcaccataggattattgttttgatgtatctaatattagactgtctagttagcaagataattggaagaattttacaaatttctgtaatattttaattcttatctaattgaattaactccttagcttcaaagtccctaataaaaagtataaaataatcaaaagtatttttaaaaagcttttaatttttaaagtaaataatatacggtttattcactcatacattaagaacttgtgaaaacagaaacatacttcataatgttaagttaaaattgttctattttagttttcaaatatttttaattttcttcaaggagaaatgttaaatgaaattataaccattagtttttataattttgaaaaattttctctattactctgatactttagagagccacaattttcacaaatctttgacattttaagttgtttcttgatattttcttaaattaaaaaccatgtttattcagatttatgcacatctttatttcagataaactattgctacaacttggttaaaacaaaaataaatattttacaatttttaaaatgctggcttatattaaagttggtttacattagaaaaaggctcaaagaacttgtattggaattcttctaccaataaattccatcttctaccaataaattcatgaaaacatttaaaactttataagtaatcaaataaaactaaaataatctaacactgtgtattagtccatttttacactgctaataaggccatacccaagactgggtaatttacaaaggaaagagttttaattgactcacagttcagaatggctggggaggcctcaggatcctcacaatcattgtggaaggggaagcaaacacgtccttcttcacatggcagcagcaaagagaaatgctgagcaaaagggggaaaatctccctataaaactatcagagctgagaactcagtcactatcatgagaacaggagcatggaggtaatcactctaatgattctattactttccaccctgtctctccaatggcacgtggggattatgggaactacaactcaagatgagatctgggtggagacacagagctaacccatattacattgcaacactgttattctcctttctccaattggctacattttaataaatgataatatgccactttcagcaatgaccttggagtgaagtactctggctccccgctggtagaagtccaagcacggctttttgaaaaggttaagatgtgacctatcctttaactcggcaattccactattgtgaattaatcataaagaagtaatgagcatttacaaaaatgtgtatgtgtttgtatatcagtgtgtgtgtgtgtatgtgcacacacacatccacatacaaatatgtgccctcatgtgtgtgtgtggacaagaagtcagaggcaatagattgaggagtaaatggtgacaaaggcattgattgtaaacaagtcttcctaggaaattacttatgaaagatagaagaacaaagtagctggagcaagaggtaagacctgaggaatctttttatgttagggaagatttgaacctgcgtaaacattaatgagaaagaacaaataggctaaaatagatgagaccaaaggagaagtgaaggaggagttcaccaagaagcgagaggtatagaattggcagcacaggtggaggaagcacctattacattgggctgggagggagtgaggtacagattggcacatgtgtgggatggtgagggtggaagggtgagagaaagagaaagagagagagagagagagagagagagatcagaaaggagacatggggagatatggaaaatttaaccagaggcaaagccacaaatttctgctttgggaaatgtatttttagtattaaatgcgtcacgtgcaaaaaaaaaaaacaacaaaaatcagaactcattccatctgtattataaggactgatattttcctaagactgcctaataataataaaaaagattattcacaactataactaggccaagtgtaatataaaaatgtaagataatttcttatgattttgaacaggagttgatgatctttatctgtgaagtgccagctagtaagtatttcggctctgtaagccacacaatatatgtctcaaatactcaatcctgtgattgtggctgtaacacaaaatcagccatggattatacctaaagaaatgggggtgggtgtgtttcaataaaattttatttacaaaaatagatgacgggccagatgtgctaacttctggtctgaaataaaatcagtgaagaacttgacactggtaagctaaatttttgttctctcagggtattttaagctcatgcctgattatcattatatatttctgtggatcaaagagattttcttctatttatagcagaacaagggaaagaacacctattctgcggtctgtggtcctagattttaaggacgacccttttacttgtactggccggttacttaaaacctctgagccctagtttccttcttcgtaaaacaaggcgatgaccctgtatttaatcctcacagatcagaatgagaataaaatgtaaatactataaaaatggtatattattcatacataaggaaatggtcatttgcaaccaaatcagaaaatgttagttcgatctccttatgtgtaagaccttgacattatatatacatatatatgtgtatatatacacatacatatgtaatagttgtaactattaagtgaaataataatatatgcaaagtgcttggctgcagtgcctaatataccttatatgctcagtaaatgccagataatgttcttaatttctaaaggcccattaaaattctccagtgcttgtgacacatagcgcctgaaggggcaaaatcaagttattccaagtcaagcacaatgctggcaatgccagccatgggcagggcagtcacagcaacataccttttaagtaagcctcccagggctgctttgcaaatggcgtaagaaatgggtattgacaattgtcatggagcccagtgactcggaagctgagttttgcgttctgagttgaatatcaggagagagttttcattcttctatgatttggaagttacagccccagactaaaaggaaggcatctgtttgattctatagtaacacaaacataaagagaccagatgagacggcatagctaccccggggcagttttaaaataaactgcaaatgtactcatcagccctttggaggaacatttgcccctatttgttcagtatgtgcagtttgttcaccagaccagggaatgcttagttattatgtgattccaccccattaaagttcttcaagccacccaggagaggcagggtaagcagcaatcggttttccatggatgaagaaggattcaatgagggagaaatgggcagtgcaggagcaattctaactcatttctgagtaaatatatagaaaactttgtgtcaggtgtgattcaacagaaggaaaagcattctctataacagttaacctacatttcgagcaaagagtgggcttttgttccttgtcttttaaacatttttatttttagtttttatctcagtgaaatcagtgggaatctacactgatgccaggttatgcggtgttattcaaacatgaaccttcacctgggacacctgttatctgcaacagagatgatttggcttttggcacttaataagctatttgccctctatagttttaaatcccaggctttcatatagacttgtttttgacatggtgcatttttagatcctgaatatgaagataatacgcactatgcatttggttcaaacatcggatacaagtgtccattgaaagtcaattctccctctcattttctgtatcaaatagataagatttttcacatggatcttttgtcatgttcatattcatcatctcaaaaattcatgacacttattgtttataatatttatttgtaatcattcaattgtagaactttttaaaaatgttaaaaaatagtaacttaacaagactatagtgaccatgaatagaggaaggattcaaacccagatcttctgactccgaataagtttttaaaatagtatttcttattcagaatgatcaactttaacataaataaaaacacttaaaatagaagggtattgatataaagaatgatatgatataaagaacacagaaaatatattgtataagaagtttgcttcagtctgtatttctgtaaatgattatttccaaagctgaagatcaaagtaaacccacatgtgtgtggggtgtgttcacaaattatattaaacttgtgtctcccttctggcaaattggctatagataagaaatgtaaatcacataagatgctacacgttggtttacatgagcctctatatcttcctaagcacacatatccactggcaaccacaagaatgcgatgtaggcacaatactagtcgatttaatgtgattctatgattctcgtttatagaactggaggtttcgcatttcccattcctacctaattcaataactcagattgcttgatttacttttagagcaatgattccctcctgggagcaattttgcttcctagcaaaatttggcaatgcctggagacatttttgtttgtcacaagagggggttgtgtgctactggcatcttgtgggtcaaggccgtggatactaccaaatatcctataatgtacaagacagtcacccacaactaagaaatatcctgcaaaatgtcagtggcaccagaggagatgaatgcaaacatgctaaccacattcctagagactagtacgtgaaccagaatgccatttattaatttgcaatgatagctagaactgtcaaggggaccaagacaatcatatttactgatgaatatatttactccctctggaaaacctatacaaaaagccaaattagaaccagacatttatttgctaaacataaagtcaattctaagaagatagatactcctcatagaacttatcacaatgaaaactgatcatttgtgtgattatatatgtattcctcctctttaagtctaaaaactctattgggatatggaacctatctcaatatgcatcatcttaaccaaggcatctaactgtactgcctgtcatgtagtaggtactaacaaatgtttattgaatccatgaatgaatgaatctttaatgtttcagtttaaaaatacatattaaacgtataacatatacaaagcacaatttgaagcactgggattacaaaatataataagataatccctacttgtgtggaagttcctgaattctgatggactagatggacacttccagttatgtcaggctgctgaagccatagcctgccctgccaacaggcaccatgaaagagctgagcctcagcagccatgttaggtatcatgtgactctgtgccttgaccacatttgaatggactgaggtgaaagagtatgaaagcaggaactggcggcatcctatcatctgagctttagcaagaagatgtggaccctgacaaatcagattcctgtgcttgggtatttaaataaaaatactaaatgactgaattagaagtgtaaagagaagttgcaaagatactgtagtggtttgaatggtggccccccaaaagacatccacccagtacctgtgaatgtgacctaatttgaaaaatgtctttgtactggtaattaagtgaaagatttaaagatgagatcatcctgaattaagtgggtggtcataaatccaatgagcgtgtctttatgcaatagacagaaaggtagaggacacacaggagaggttcatgtgaatgaaggcacagacagacagtgcacatatgtagccacaaaccaacggaggcctggagcaaccagaggctggaagaaggaaggaaggatcctcccctggagacttcagagggagtgtggtcctgccgacaccttgatttttgaacttctggctttcagaactgtcagagaatatgtttctgtttctttcaggccccacactttgttacggagccttaggaaactaatataaatacctagaaagaagaaatatataggagtaaaagtcatgaacggcagcttgcaaccactgatgttacattgaacaaggaactgaataaacaaaaagctttgcagtagggaaataacacagtctggaggaaaatactgagccagtcagtggtaaaagacacatagaattggatcatagagagcagccacgtcacttctctggttaagttctggtgtaaagatacacagattcctgctcttgataatcctgctgctttggaagaagcttttatttcctgcttatccattaagaagtcaggcatgtttggggtttatatttgtttaatcttacaggaaacttcccatcatttcctaaggctgaaacattttgtaaagaattgtaaatagaaaattgcaatataaaacagaaagtagtaaacaagtccagcatgccaatgaactaatggactccaaacaggaacacttggtctggctagaaatttcatgaaaagcttcctggatgaattcattaaattatccctggcatatcttgaaagtggagtgggtacttttcaactgactaataagagatgaaaggacaagaaagaaaaattttcaaaaaagaaaataaaaagaaaactgaaagcagagatgcataaaatcatttgggttatcatcttactatgtaacgggatcgagctatgggcacgtgagggagacacagaagcaaaagatactgaaatgttattgtcagcagattagcatgccctgcctcccacagactttttttggttctatgataagcaacctcttgagacaactgatgtgcctatagttttagatgggctaatacaattccattcctatgagattgcttcaaagttactaactcaagatatatttgagatttttccattttgccccttctgcagatagctgatgtaatttcctgcatttcttcttcccaatcttttgacaaagtaaacatttgaaattctgagtgtcttgaaatatagggaaacaaaggtctctgttctttttttctggaatttgaattaatgccttttatgtaacatcagtgtgaagatgatgaataaagaatactccatagatgagaaatcaaaggagaagaaaagtttaaaaaatatatgtgaaaataatctataaaatagtaatgttctatcagactcccactcactaaaaaaatgaaaaaagtgtggtttctatttagtccctttggttgtaagtaaatgatgtgtctagtctgtgccaaacactgtgctagcttcttagtataaaaaggtaactaaaagcacagcttcactcaaacataaattatgatttagtatgtcttgaaggtatcattttgcctgacagtataagcaaaaagcagaaaatagtgattgattaaccttattttgtagtgatgcaggaatctaataaacccaaattaaggattgaaatgaagataacaaaattgaagtaaccaatatttctggttggagcccacttttattacagcgctaaaaatagtcattgacataagaaaggatagatgaatgccatcttgttattttccagcactgagataggtttagatgagtatgtcggagataggaacattaagaagttggtagccctcgcacatatgatgaataaagatagatcattataaatggcttcaaaactcttttcttcgaaggttcttactgggcttattataaaaggaacaaagattgttagaagatatgctgtcttcactgtctcaaaaacaatactttttgaaaccttctcaagaatatagtgaaatggataaagaacctctctgagaaactcctgttgtcattggattttgaaagttgtcataaaccacctctgtacctaacctaaataatgaatgttgttgtctttgttgtgtttaaaatataagtattgctaccaagtatattacaatattatgctgtatcactaatgtaaaattgtgttttgttaaaacaaagttatgcatttttattgaaaataaatatggaataatataaatgtttagaagctggttagaagaaattattcatctttttcatagaagttcttgttacttcattaaaaaattcatttccttaaacacacacacacacacacacacacacacacacacttccacacactaatcagtttctgtgaacaggtaactttgtagtatcctatttgtatccacatttatatccatgttattagaaattctaataatcttatttaaaggtagaaatttccaagttaaaaattaatattcaagttaatgaaaaaataatttgtttagaatttccacatgaataagacataaaaataataagtataatttataaaagagggaataaaattgcaaagtacagaaaaaatataactgtagtagtcatcaaagaaatgctaatttaaacatggacacaatttttcattcagcaaaattattttgcaaccttttaaaaaataatatgcataataatttttaaaacatgcttaaggaatcaatcaataattataaatatataaataggatattagacatctaaaacaaacttaaaaaaatatataatgtagaaaaaagtactatatactaataagtgaaaggaactgtagaattataaattactatacgtatcatattatgaatatactataattatgttataaatgttaaaagtttaaactagattgaagtaactataccaacatgttcaattagcagtgtttaagttaacggtaggatttttactgtgtgtgcgtgtcgatgtgtgtgtgaatgtttgtgtggaagtcacgtctatcttttttagtaaaagcagttgcttttatcagaacaattcttgtccgaccaaatcaggaaactccaaaattcagctaaaatatgacatatgcaaaaaacaataggtgagaaaatactttccaaaaatactttatgtaagtggaagtgataattgttgtctttgcaatgatcaagaatgagccttaagtgaagtagttgatacgaacttttattttctttcctactttctttttttctatatttcttcctccctgtcaacaggtgtctgcccttttttcacgtctcaaggaattaattcctatctcactcttcttctgtcatcaatacttgccttttgatattaaggccaggtgaattgctgatcactccctgcacttggccgctcctatcttgtcttgcagccacatgaattaggtactagtaatgaaccctcattggagagtctgagcctcagtgattctgaattctgtctccacattatgtatcatttgggcagattttcataagtagggtcatcggctgcccacttcatgcatgctttcacacctccacccctagaatctgatccttacttttctggaatatggttcaggcatagacattttcaaagctcctggggttgtttggaggcccagccagctttactaactcctggcctaatcctaccaatagaatctcattctctttgctacagtgcttgctgcaagcttgggaagctctaagccattcagtgaccagccacagggactggctcaggaaccttctgagccaaagagacaccatgcaagattacctgaggaacttctcagggtgaggatgggagcagaaacttccttttcctttcctgaacatttcagaagtgaccgtcaattcctggaaaccttggccatcttgctccctctgtgaggatgagggttgacctacaagaattacagagagaaggaggcagaattctacatgggccaaggcgggtcacagctctatgtttaattttttagatcatctgaaccaaaatatatgcatttttctggtgttagttcaagtttgatttttctgttaaaacgagtacattccaatgaacacagtttttcttcacacagaggtgtaaaaaattgatatgacataatatgatcctataaccagaggtattttcattttaataaaggttgagtaacttcctactaaataataaaccttttatggtagaattttaagcatcggcaagctgatgaggtaaagagggtactttcctggcatttctgaaatcaattttaactaattgaacacttaacaaaaatatattgaaattgaaggactctgattcgtacctcagtcttagcttttcacttacctcgtgtatgacttcagttaaattacttaatttcagctgggcgcagtggctcacgcctgtaatcctaacactttgggaggctgaggcgggtggatcacaaggtcaggagtttgagaccagcctgatcaacatggtgaaaccctgtctctattaaaaatacaaaaattagccaggtgtggtggcgcattcctgttatcccagcaactcgggagactgaggcaggagagtcacttgcacccgggaggtggaggttgcagtgagccaagatctcaccgttgcactccagcctggcaaccaagtgagattccatctaaaaaaaaaaaaaaattacttaatttctttaggtttccttacttgtaaaagtgtaactatatcataggattctagtgaggataaaatatgaaataatgtgcataaaatttattagtgtgcagtggctggtgaattaataaagatgggacattctattttattataaattgtaccttaccatatgcctatatgctttgttcctcttagtaacatagtagagacctaaaagccctaaaatcaaaaagtaaaggaagaggagaaagaaaaagtttatgttagcattgctgtttgagtctccacagatgtatgttcatcagtgcttgcctattgaccagtcttttatttgatagctggtagacatgtgaacacacgccaattgtgtatagactcatgacaatgctacacctaaatggtctcgcttatccgtgatctttcacctctgaccggacgtttgtatcttttgcccccaacgtggcagctaaaaaggcaaaggagaaatgttttaaagctccaaagcaaagcttggttctctgatgcttgcagacactgtctacatacctagctccatcgactgcatctgtgaccttgtctgtctctcctcctggtatgaaatgattatatgtaggcagagactttccaaacctgccaacactttggataattgttaaaacaggtttaatgtgtaggtgaaatccaaaccaaaagttaggacacagaaaagtgattcagggaggtgcatttatactatttcatttgatattaatgaagttttaaaaactgagattatgtcctagagtaacatatgtttgctctcagaaaaatcactagataagataagggactatttaggagtaagttcctgagacatctggaattttctatcagtgataccgttccctatcagttaaaggtaggctacagttttaaaatggacaaaattctgtgtatgagttttgagtaatagatactgtggctgtattcttaaaacacagaatgctccagtaataggtcagagtatttgaagttttgaaacatcctagtgaagtttgaactacacattgctgaagttaggactgctgtcttctacgtggcacagctgaatttggtagatgattccaatgattaattttaatattaaagttttacattttaaataaaacatgatcctgaaactagaatatcacatcttcaaatatttataaaacgctgtgtcctaagtcctagcaattattgtaagacacataacattgcctgaaattatttagatggacacagtgaatgtttacgtaaccttttaataggaaactcgagttttgtgttctcttcaatacaagctaagacacatttctaactaagttgatatttaaaatacataccacctaagtgaacactttgtaagttcaaatttggtattattgtgaaaacttaaaaacatcaaatatacctttgaaagtttcaagtgaatattgactcctaaatgagtatgaaacagatcagacaattccaaatctctatttaattcaacatttatttatactactaacatcatgggagaaaaatgagtggttctgtttttcgttttgttttgtttttttaacaaggtcttgctctgtggctcaggctggagtgcagttgtgggatcacaggtgagtgtagtctcaacctcccaggctcaaatcatcttcccacctcagcctcccgagtagcagggaccacaggtgtgagccactgtgcctggctggttccagatcattttaaagaaattaagatgtatttatttgttttattggcaattcttagttttatttaggaattgattctcaaagtaaaggtgctagcaggatatggaaaatgaaatatgggaagaaaaacttaaacctatttttaaaatttttatctacaaatagaaataaattaggaaataattcggctttgttcatatttaatatatggatagacactggtgtttccacttccatatgtcacatgatcatattttatgtgtggtgccaaggtttcccagggagaagatgggttgactacacacctattgtatttgtcttctacgtcttctaaaatgaaaggtggctaaagaagattcttaaaaaaagtctcagaaccagtcttacaataaaaatgcaaacaaaatcaacaagaaaatgacagggttgttatttatactcccaatacaaactctttctttgtcacatcatgaggtaaaaatcaatgatgatttacaagagattgatcagagataaaaaaattacctagaaagcaatttgaaatgtgaattcatccactattgttattaaatctgactttgtatgtgtattattgatgattagctagtgttcgttttagaatggaaacaatgtgtagaaatagaagcattatttttcaaaacacacattttgggagaatgtaaactcaaaattgtatcgttagcattgcacaatctaaaatattcggagatgagtaatgtagcgccaaagtatattaaaatgatttcacctggtggctaaaataacaccaaaaacaatttatagacattttataatttatcaatttctttttaaatatattatatattaaattacataaaagctttacaaggttgatgctgttttccccactatataaatgcaataatcaagattttgaaagattacaacttgtccatgggcgtaattaataaatagaacagcataatctgattgctgatcttttgattttaaattctatatttttctagcttccagttttagttgcacacaatctacttagctaaaactgaatttggttaattgtcaaccaagactccaaaacatctttgttatctgatgttcttcatttttactttttaaaaataattgaaatgtcactattatattgacagtaaattcaccagttgttcgatgagattaaccttcttaaaggatgatcaaagcatgcagtgaagggaacctgacggggtttgactgctcagtttatcactgaacagggcacaggtaggctgagtgataacaccactcgtctctgatcagggactcatttgtgccatctggattagcaaagatttcccttccatttctctgctccctgcctcccacaggctatgactatgcttcttgtggtttcatcgcttgctgctgagcggtgttaataactacttgacatttggtttcccaatgatgttcacccaatttttctctaatatacagattctctgcaacacttctcacagtaattccagtgctgtagatatttcttggacatttatacaaaacatttaacttgtttccctgtaatagatagtgtaagttaaggttcacaaagaggaacataatttgcaaattttaaaattgtcctccctttactttaagtaggtaaaaataaagatgcaattgaccctgtcgatattgacttcatagagacatggatattaatatgtaaaacaataatctaaaatgagttttgaaaagaggtataatataaatccttaactaattaaccttgactatcataagtgcattcacatttcacttgcttatagtccatgacatggaaaactactcaatcaatagttattatacagaaacatctgaatcaggcataaagaatttggctaacatcaatcctttatgttagtgaaaactgtaaaaaatttgtataccaccgagaaaacatttaaggttttattaagaaggttttattaagaagtgaactatttttaggtaaactgtgaatccttgggaagaaaatgttatctttctcttttggagtggaggtgtcaaaatttacaaattagggtcaatagtagactagagtttgcttcacagtgaccaagctgaagttttctttatttttccctccctcccctcctcttccctcatctcccttcccctcccctcccctcccctcccctcccctcccttcccctcccctcgcctcctctccgctcctttcccctcccccctcccttcccctcccccctcccctcccctcccctcccctcccttcccctcccctcgcctcctctccgctcccttcccctcccccctcccttcccctcccccctcccttcccctcccccttcccttcccctcccctcccctcccttcccctcccctcccctcccttcccctcccctcccccttttccttccttccttccttccttccttctctgtgtgtgtgtgtgtgtgtgtgtgtgtgtgtgtgtgtgtgtgtgtctctgcctgtctttctgtctttttttcaaggagttgaagtttcccaggcagttggtttataggggggactctctggttcatgggcaatcgaatttcttacaacatagtctatgtgctgaggtggggaaagcatgggagatttggaatcagacagagcaaatgagctcattttaatccctaactaactttgtcacttgggagaattatctgctttatctgagtcttagttccttcctctctaaaatgagaacaatgataacttctctctctctctctttttaacttttgatgtttcattgattgtacataaaacctccataataagagctgagttcagtccaattgttggtgaccgtgcaaagctagacagtggtaaattcatcagggtacatgccacttagtcacactaagtctttgcaatagaaacttctgcagagaccagtctacctttttttgttgtctttagagcaatttaccaaatcattaagaactttgcttttcttaacacttgccatcttcatactcagccagaatgttcttttcaaacaaaaatgtgattttgccactccctgttaaaaacccctgaatgacttcctgtcattcctgagacaacagcccaaatcctgaatacaacttctagggccttccttgtctgacctcatccgacccctacagaaacagagccatgatccataaacgttctactgttcacctccctgactgtggaaagtgattgtccttcagtcttgacttgacccagtgcatttctttaaatctatatgtaataatcagaatataggagctgagcacagtggctcaggcctgtaataccaggactttgtgaggctgaggtggaaggatcacctgaggccaatagtttgagaccagcctggcaacctagggagaccctgcctctacaaaaacaaaacaaaggaacaaacacaaattccccccaaaacaggtgatgagaacgtccctctggagcaaacagaacaacctcaataagaagagcaagtattgctaagagtcacctaaaagcaactgcaaaatgaatgtgaacttaaagtaaaagcaaataaggtagacagggacatttctgttgttaccacctttttctaaagaataaaaatgtttttaaattattctttctgcctttttacaaactaacaaaatttgatcttcctggggagtgggaaggagggatgactcatactgctgaaactcacgtgagatcaatttgtgtgctctaagatcaatttaataatttacactggaaatatctcttcaaagtaggtgtccccactgggacattaaattagcattggaaggcttgcttggcgaatattgaggctgacttaggcaggtgctgagaggcagataagccttctgaacgtaacaggttgcctgtaggggcaacttctccttagtgttttgaagacatattatgatttttctcctccccacaatccttgtttgcaaagatatgagcttattttccaactcattcttacctccatgttgacctcaggaaaaaactgaatgcttcagggagagagctttcaacagacgctcatcttttcttaaggcttgtgacttctaatcacaagcctccaactaagcaaaatatgcttacatacacagatactgcctaaatggggagattatatttagatatatttgagcgcatagagttgatatgacaagattctcaaactaagtaattttcaagtttactagaattttgctgcttaaagttcctgttaatacaagaaaggaccagaagatatctcatttgagccttggaattctaactttgtgttaaaaattattgttatcttacctggagaaagacatctctaaatgctttgtaaatgttacatctgcttaagtagaagtataaaaatagttgtctccaaaaatttaaatttgtattaaattttctcttatgtcttaaaattagaaaatcgattcctatgcacttaaacaagtgataaagaatttgtgttttgggccaggagcagtggcccacacccataattccaggattttgggaggcctaggtggaggattgcttaagaccagcctgggcaacatagggaccccgtctctactaaaaattaaaaaattagccagtcctggtggtgtttgcctgtgttcccagctactctagaggctgaggtgggaggattgcttggacctgggaggccgaggctacagtgagctgtgactgagccactgcactccagcctgggtgacagaatgagatcctgcctcaaaaaaaaaaaaaaaaaaaaatttgtgttttcttggtttgacctttggagtgtacaagaaggcttggaagttatagaaaagttaattgtttttggtgatttcagaatatgtacagcaggtcttcaagtctttgataggttcttagaaactgtgactttaagtgaaaggctgtatagcaggccctcagataatgttgtttgattagacgttgttttattataacgttgatgagaaaaaaaagtgttttattttatgccattttacttaagtcccagtttccaaaaaccttaaggacttactctatttgaaaaatgaaatgaatattattaatattaatatttgttgactgaataaagctgtgtaatagcccaataggctaaatgtttaaaatcaggaaattacaattactactgtattttacagaactgtaggtcacttaattacttttgtaatctgcctataagtgtaaaggcaaagggtagagtaaaattagtaatttttttttttttttttttttttttttttgagacagaatctagctttgttgcccaggctggagtgtagtggtgcactctcggctcactgcaacctctgcctcccaggttcaagcgattctcctgcctcagcctctggagtagctgggattattggtgcgcaccaccaccctggctaatttttgtatttttagtagagatggggttttatcatgttggccaggctcgtctggaactcctgacctcaagtggtctgcccgccttggcttcccaaagtgctgggatgacaggcatgagccaccgcgccctggcagatgaatacatcttatgccatatgcctgaccactccctcagacaaatgagaaccaatgtaatggctgaagaaatggctgcttttttccattgaccttggtgcatagtttctctcctctccttacacaaaaagtaaatttaaatgaacaaagttaagaaggcatattttatgtttataaagctttgattcatggtacaaaatacaagttttcttggagaaacagaagctatttaaaatgtagaatgcagagagttgcattgagccacattccttcttttatctatctcatgggaattaacagacaatgaaaatattgactgtgtttatgcttaattttccctcacccttaatacatttttctgttatgattaattactttcctgtaaaattttgaatgaaattatttaaagagtgctatagataagtgtgtttttactaattttcattattcaccattgtggtataaaatcaacaggtacaagtcaaattaagccctgctgtctgcatgggtactcattattaaatatgagcgatttgggccttcagcaaacgaccatttatattccaaatcgtatttaaaattaatttactcttttatcagaacaaagaaaatttcacacacacaatctcttttactaaaaaataaattttatcataggaaattatctcattttatattccagagcagaaacatacaaaggtgagatgaatctttgtacaatatgtctttctgtcaaacattctaaaacattgtcaatttcattttttctagtattttcaatatttattttgtgtttggcaataaacggagctaatacgaccacttttctcttatgcttggttattattattttaagaaatgaaaacttataaatcatatagcttggaagattgctggcagaataagaaaaaataattttatcttttgtatacatgaaaagtttaaaatatcaaactataataattagtaattacatatgtaacctaggttacatgtatgtatgaggtatggctcacacccatcatcccaggattttgggaggccaaagttggaagattgcttgagaccaggagtccaagaccagcctgaacaatgtagggcaacacatccccaggcctgggtaattttttatggctccatttaaagaagcagcatgacaatgaaccttagatgtcatccagttgagttctcctacttgagcatgaatcccgtcttaaccctcagtttagcaaaccctatcagttatggagagcagataaatctcagcctacttaaacatgaagacagaactcagaaacagttcttcaaggcgctgccccttgttaagctggttctttaagaagcttatccgccaattcacaattctgaagcacagcaaagctgtttctgtattggtgttaattatttattaatgcagtgaaaacactttaaattcctattaaattgtcactaattacttgtgaactaaaacgtaagatgtttagttttttgcttccttctgagaaaatatatttgtatcgccatctttgaagtcagttctactgtaaagagcgtgtatttgggaatcagaaaaaactagatcgaaactgtttgtgttttattgggcaagctacttaaacactttgaacatcatcaggtttttaatttatgatgtaagaagttcagacgaatgaactgagtttatttgcctgcttaaattaaaacatatagaatccctatgtttcccccagtctactcaaatgttttcattgcagtatcaatgccaagaatattgtcactgcatagcaaagcattggagtgaagtagctgatatgtattggatgacttagtttcaaaagctgtttttcctataataccgtaattccttcctcaaacggaggcaacagaaattgcagtagagttcccttgccaactacaaaatgttccatttcattctgcttttctccatttcctagaatcagttacatcaatttgaatctaactagactaagataaaacatgatgaatatgtttgtgaaataaaaacttgacaataaatccttaagatttttctaagaaagaagtttatgaaacttcagagaataggagaatatttcctaataaaaaatagaaagcatgtaagaatatcttctgtcttttaatacaacaaaccaggggcctgcaaactgtatctcatgggccaaattcagctaggtgcttttttgcgtagcccttgagctaaaaatgatttttaaatttataaatgattgaaagaataaaaggataataatatttcatggtgcatgactatatgaagttcacgtctcagtgcctataaactttattggaacacagccatccccatttgtttatgtgttgtctatgttactttgagagaggtgagtggcagccacagaaaccatatgtgtccaataaagcctaaaatatttgctacttagaccttcacagaaacaatttgctgccccatgttcaataaacagctgaaggcagggatggtatcaaatctcaacacctgcttaagtacttgacacatagatctgcacagaatgagtaacagcagaaagaatagatttaaaaaattaaaattattttctcattataaaaaggaccaaatatctataatttttaaaaagccaatagacttacacataagatctgtaatgtaaaactactagaaaaaacacaggtgaatatctatgaggtataagtctgggcaatgattattttggatttgaccccaaaagcataaacaataacagcaaagatagacaaatgagattacatcaaaataaaaatgtcgtgcacataaaaggaaacaatggaatgaagagacagccctatggattgggaaagaatatatttgcaagccacatgtctgataaggggttgatatcccaaatatataagaaactcaaacaaatatatagaaagaatacaaataatttgattagaaaatgggcaaaggagctgagtagacatttttcaaaagaagacacaaaatgaccaaaaggtatatgaaaaaatgctgagcatcattaattatcagagaatgaaaatcaaaaccacagtggataccacctcactcttgttaaaatgactgttgttcccctccctttgtgcatgtgttctcactgttcatcttccacttataagtgagaacatgagatgtttgattccctgttcctgcattagtttgttgaggataatggcttccagctccgtccatgtccctgcaaaggacatgatcttgttccttttgataggtgcagcaaactaccatggcgtatttacctatgtaacaaaactgcccattagcacagaacttagaataaaaattttaaaaaatgagtgttatcaaaaagaaacaagagaacaagtgttggtgagaatgtggagaaaaggaactcttaacacactgttgatgggaatgtaaattagtacaagcgtaatagcaaacaatatggaggttcctcagatattaaaaatagaactgccatatgattgagcaatcccattactgggtatactgggaactgaaatcaacatgttggagagatgtctgcactcccatggttagtgcagcactattcagctttacaaaagaaatgttgtcatttgtgacaacagtgaaattggaaaacgttttgctaagtaatataaattaggaacagaaagtcaaatacgttatactctcacgtatatgtggaatctaaaacagtcaaattgaaagaagcagagagtagaatagtggttatccgagacgctgggagagaggggaatgaggagttaatggtcaagggtacaaagctttaattacacaagagaaatacattattctttgggatatattgtaaagcatggtgaatataggaaataacatattgttatttcaaatgttctcaccacaaaatatggtatttaagatgatgaacatattaattagcttgatttaattattcaatattgtattcacgaactataacaccagtttgtgtcacataaatatatacagctataatttatcaatttacaattaaaaaataaatgaaataaaattggatttaaatgaaacagtgaaaagtcttcatatagatgacaagcacaataacttcattttaaaatttataataccatgaacataggaattcccaggagaaaatttaggtttatgagactatatccattgaaaactctgttggacattttttctgaagttgttcagttttagacctgaaacaattatcttttatcatttaataaaaatggattagaaaatcgctctgtataattaatagtttgacctagtcttctatgatggtttattgattgtttcaactccagagctggctagcaacatgaaactctcatggaaaacctgtttataatgaaggatgcttctgaaacaatatacactattatatcttgattgatagttaacatttagtaactaagtacactagtacatttgacttacaggccatcattttcccttaggagacagtaactttgagtctatcccattcatctcctctagaactttgtcaaacagaggtatatatggcttttgatgctctcctttcatttcacgttgttctttcatgtttgatttgcttaatgctcattgggtttctttttaattcctctaaattatctaatttgaaaaaataactattattaatatactctcaaaaactgtagaaaaaataatttctaaataatttaaaaggtaaaaaatatcaacatggagaccttccataatgtaaaagtggttctttttttaataaagccttttctctactcatttaaaaaagtggagttggaggggctgcctttcaaaatttccacataaaagcaaccaaaaatttgttctaggaggagcactgatggcagtttctgaaaagatttccgtgacaccttagataagagtgaaaaaatcaaccccataaggaatttgtcttcattcactccatactttctggactgggctttcccttctggctagtgattagagctgacagacaattcgacagaatcacaaagtggagaagttctttttaaatacaagttaatggttttgtaaatttagtgccttaagcaaaattgaattaaacattcagtcattcatcttaagcatccttaaaaattgaaagcttcacaatatgcccagaacccagaaattcaagtaacttttacccagagcctacccagccggactgcgcaaaggactgatgagacgaaaggatatttggacgctgccctctaggaaaggtagcctagaagaggagaggacactaacagactaacgactccttcagaggggaggaccacataatcagccaatgtcagctggcccagatccaaacagctttctgcttatgcaaaccttgtgtggtcgttgtgttaactaatgcaaagatatatgattaatgtacttgtcagtgtcctgtgtttagttttctcacaaaacatttcttatataattgagataattactttcacttacaatgccattggtttaagttttaattgataatgatgactttacttttcagtttaccactatagacttttatttttagagtaccattcagagtcagagcctgaaccttagagaattaaactcacttaagattgaagtagtagtcatttcatactttgtgtatttatccatgttttgagctaattccagaatgttgtcagtcatattgggatgcgatatagtaatttggtttttaagtatgattttggaactctaagttactaaaatagtagcttaatttttgttcaccaaaagaatttataactgaaacttccattagagattatatgctttttatttactacttttagccattaaccaattaattataaaatatagagattttatgttttcatctacatatacaaaattaccattaagatgaaagtaattgaattgattgcatattcagttatagaattccaaatttaagtagacacagaaagtcataagtttacatctaaaaattcacgaggtagtcagtcatagtcactacattttagccaactatggaacgtgtactatcatgtactatgagtcagtccctgtactgaagatatcaaaatgaatttgacaatctggtataaaatccaggactattatttgtactgccagcctcagggagagatgaataaaatggatttgtaagttagaggctgcaaaaactgttttttttggtttgttttgctttttgtttgtttgttttcctgcaaaagcatgtattcagggtacaggtggtggttctacccttccagttttctaggctggctgatctttataacttgttgttcataaagatgtatgtaaataagcaccatgtctcaaatttagattgagaattgttctcccagagtattcaaatttttaagagataaaacaattaaaatctaaaatatgtgataatctaaatacatattatacccccattcacccattaaaatattttttcttgctaataaaagaaaaaatcgtttttatggattttcctatccctcaaaaataaggacaataacattttgcctatttttaaaagatattggttagatgaatcttgtagatctagctcaattgttcccattctagaaagcttagaattattatcctgaaagcagaaataattgttaaaaatgaaaacatgaaaactttacataaatgacttcattttcacctcgtaaactttattgcacagcaccgcactccagcctgggcgacagagtgagactccatctcaaaaaaaaaaaaacaaagaaaagaaaaaaagaaaaattttattgatttagaatgcttgacagagcaaagtgaagctgtcctcacagggttagtaagtattctggacagaaacatagttataattaagcattagtcaggctgtattttgacctacttccttacaaccaaagtcacatagcactagatactgaccatttgcatcccattgcttgtatagataggattctgatgtaggatagataggatctctgatgttggaatcacaaggctttttaggaattgcttaagcagatcctaaattccagcagaacagcggaccccagccagtttgaagacactcacagaggaactgagtcacctgagaatagtttctttatctccccattccatgacctcaccctgcactcttcaaccaattcatgatctccacactttgggctacttcagagcctgtgaaaaccctagtcccagactccccaaggtgatgtgtgtgaggttttctcctgtctcctcctttggctgccctgcaatgaaacccctttctttgctgcaaactggtgtctccatgtattgacttgttgagcatcaggcaacagacatatggttacaaaagcagaattttctcttgagtatttagagagctcctaggctgttctgattccaggcagcagacttcaggaggtagcatttctaattttctatcatgatgttaagggaaatatgctgcctgataagtgtttggatattggatattgcatggttgtcccatgtcccagtaaaacacacatttttgctttgtcctggtaattaacaatacaaacaatataaattaatttggccacgtattttagtataaataacacagttacaaataatggtctgtttgtcatcctgtcacctaaatctaaaataccgagatccagatgaaatgaaagagtgcacattttaagttgcataaattatatatatgtatgaagacttaaagttcagattttcagaaaactaaaaagttcttaatcatttttagaaagtagatcagcaaagtactgagttattttgtataaagattaaagcaggtattatctgtgtgtgtgtgtgtgtgtgtttctgtgtgtgtgtttgtgttgttctaatattaatagaaacaatagaaacaatatttctttaatattacttttcaagaagatagtaaaagccaagaagtaaaagtgttttaattcttgagctgttaattcaatttttttcttgaatgattgaatattatttccatcatttgttcattgtaacatttcccaatacttatagatgatatatagaaaaacaatttaaattgaaaatcattaatttcccagtgcatttcctaatatatctatattcagatctgtatgttttcttgttccataaagaaaaagataccttcgtttttttcaaattaatatcaagagcattaagttttattgaactaataatcttcagtgttgtctatggatttaaattccattttattgccattttgggagactaaagacagaaagagaaaaggaagaaatatagatgggtgatcaaagtaggtaaaaccataaagatgtgtgaaataaaagtgaaatagaagaaagagatagccaaatgaggaaaacaaatcacagaagagaataaaggcatgtaaagcatacaaaactagaaaaagtgcaggaaagagaaagaaataggtagataatatagaaaaagttttgaaagtttcagtaaatatgataaggattccatgtaggtaataactatcagagagttataaatttatatgtacttctttgaaatgtatagtaattggcattaatagcttttaggttattccaatgtttatttgtagtgctatactcataagcataccttctataaataagcacattctttatgctagaaagataatgaaagctctatctggtaacttgttttccatgttgaatgctacaaacacactctctaaacgtgttaatgtgaatgtgtgtacccttgcatacacagacacacacgtaaataaaaaaaactttattatatgaactgctagcacaaatatgtgtattttgtttgaagaaatactctggtaagtttcttgacacttactataaaacgtgagatgctgtgagcatgaaagaaagtggtcattaacatacccaaaggaagagatgatccttctatgctataaggaaaggaaactattggttttcttacagaaaacaggaggtagaatcaaagaataaggcaagggaggacaagagaaaaagacagtctgggactttgtgaagagccactatttgcaagttgaatgtggttttttgctttgttttgttttgtttttcttgctattattgagttattgttctgtgtttcttcacgagtcttcaaaaagtctatactgttcacagtgcttggagtgacagggttttcctgcagaaggctacacattcaagcataaaaaaagaatgtacagcagcttagctcaagaaacagaagatattactagtaaatacatcacccccacagctttaataactgcccaccccctgcaaaaccttaggaaaagtttggaaaggatttgacatctataatctgtaaagttgcagtaacagcagagtctcaaggcaattttgcctaaatttctgagaagctgagggtcatgaggttgcaaagccttctgtccagatgtggggctatcaggggatttggagtttagctttgtttggttgttccctatctcatcaatttacttttcacaaaatctgcctctgaacgttcgatccactgtgaatatgtttgaagcatgtttttgaatgcatgttcaacactggagaaagtagattacagttctgctcttggacagctctggtccagcactgcaggtggtgaatgtaagagtgatagtgatgtgatctcttagagaagaatgatgtgttaattaatttgaggaatggaagagcatgcccttgacagtcactgtgacttgagtttgcgtgctagcacctccatttgagctcagatttatttaccttgtaattcctgtagaatatagatgatatgctgtacttcaaaatttcattgtgaatattaaaagaaataatacggccaggtgtggtggatcacgcctgttatcccagcactttgggacacccaggtgggatcacttgaagtcaggagctcgagaccagcctggccaagatggtgaaaccccatctctactaaaaatacaaaattagccaggtgtggtggcatgtgcctgtaatcccagctacttgggagggtgagccaggagaattgcttgaacccaggaggtggaggttgcagtgagccgagatcatgccactgcactccagcctgggcaacacgagcaaaactccatctaaaaaaataaaaataaaataagatagaaataatacacacagtgttcttagcaaattccttggtgcacaattatatggtagttattattatcaaaattataaagcagaaaaaagtctcaaagccaatgattatttatttatttattttagagttggagtcacggagtgcagtgtcacgatcatagctcacagcagcctagaacccctgggctcaagtaatcctcccatttcagcctctgaatacctaggactaaaggcatgggccaccatgcagctaattttttagttattttattttattttattttattttgtagatacagggtctcactttgttgtccaggatggtcaccaacactggcctcaagcagtcctcctgcctcagttttccaaaatgcagggataacaagcatgagccactgcaccaggcctgggaacttacagcctagtatattccgcaattatggagggggtacgacttatgtgaaaccttcaggaatgcatacccttttagagagaaataagtcttaagttagagatgagaaaaagcatgggaggctaccttctgaatattgaaggtaggtgtaagattataatggtagagaataagttcagatatgaagaataggcctaggttatggcagaccttgaacttcagagaaattttagctaaatatgaaggttagaaagagccattatacatttcagaccatggaagtaatataagctggtcgtttagaaaatttcatcaattgcgttatgcaagagtaactgaagttcaaagagatggtttttgagaaggtgactggaaggatttgcagttatcaagaaatgaggtgaagaggacttggagtaattttggctgagaaaaataaacctttacatacagctctaagtctataagaacaaagaatatataacaatccacatgtagagtataaaataataagaatgctatcagtaaaacaatagtgaaaaagaagcatcacatttagtccataaattaaatcgtgtccttaacttagtataaaaagatctaaggattatggtataaatattgcacactttttatgtggtggacatgaaagcaatttctgtgagtttaaccaatggaaaattggtactcttggataaatgattggccctatacttgaaccattaaaagagagaacattaaactaagtagacataattttgagagttccactacattaaaattgaagaacagcttactaaaaacagccagacttaagggtaccatattgtataaaaatgttatattttccatattataaatggtttggctgatagatacttaagaggaaaaatatagccagagtcttttaggttggccatatagtttcaagttttcaagttatcgaaaatcaacccatttatttatttaaaactcatactcacctgcttggagacataatttggaaatttataagttgtatatacaacttcataaaatctgaagaaataaatcaaaataggcattattgaaaagcagcaacataaatgtatgtcattgggattctacaatgggtttgctgtaattatatcgtacattgatgttaactctcagtttcctgacagctaaaacaaagagaaaaaaatattataggtattaaaatgtttatacaaatcatttaaatctgcagagacatgcatgcttgtatttaagtgctgagggtggactgttcaacataacagatgattagctttcacctgaattttacaaacatgctatttaaggcaacaaatacattaattctatatagaagttaagagaccatacttcagtggagggatttccttaagagaccagcagacccaacattccaggtcaacagaatcaaagcaaatgctgtttataataatacaatttagggatagttgtggtaaattttaatgacatttccaaaaccaattggagcctatgcaccttaatttgaaacattgtgaaatggactcaggattaatttgagaatagaagaaaagaagactattccataatttcttttacagaaaattatttatcttctttccatttaagaagacatacatggtgaccgggcacagtgactcacgcctgtaatcccagcactttggaaggctgagacgggcagatcacaaggtcaggagatcgagaccatcatggctaacatggtgaaaccccatctctactaaaaatacaaaaaaaattagccaagtgtgacggcagatacctgcagtcccagctgctagggagggtgaggcaggagaatggtgtgaacccgggaggcggagcttgtagtgagcccaaattgtgccactgcactccagcctgggtgacagagtgagactctgtctcaacaataacaacaacaacaacaacaacaacaaaaagatatacatggtatcatttcaagaccactgcctacctataatgtccaaagttgcatgaatgatctccaaataaatgcacatgtacattcacagtggtgcaaggaattttctggaaggagcaaacataaacacgggagggacagcctgtgtgctgggtgtggaagtaaccaaagaaattgttgtggtattgtgaaggaggttgatggtaaacctcttgtcaactaatgaaagaggaatgattatggctaagttgtaagttccacctccctcctcatttccaaaaatttcctgttcaagctacctcgtaggacttggaaaaggtacaactcttcttccactctttctgaaaaattaatgggagtctgttttccacaaggatagaagaatattatcctgagtagtttgtcagtggttgtagtggataatttttagtgtacagcaaaaatataatgacatagtgataggacaaatattttctgcaaagcaaaaagaaagtaaggcatcatatacaatttgttgctacatgacaaaatgaaagatttaaaaatttaaaatttatgcaccccttttcagtcccatataatagaagtttgttttgttattatttacagatgatttaaaaatatttagacaatcgcaacttctgtatccatcaatttggtaaggtaatattaaatgacacaacttgtcaactaagttagtcaaaatggtttatatatgtgatctttcattcacttagtcaaaaatcttaagtgcctattgtatggcagaaatattaacagctgacacatatagtatctattctatttcagagatagtattaaatgcctgatgtatattaacacatttaatcctgacaaagattcttcaagatttatggaaggaaaaaactgaagcaaaaaagctaagtaatttgcacaatattgcgtatctaaaacgtgttggagttgagatatgaaaagacagttcaacgttagaggccgaactcttaaacagcacggcatatggcctcttgagtcccgagtgataagctcagaataaaatgtgggtcaaaccatacaattccagccataaaagtgatgaatgtagagctcttaccatcaccatcatcatcttattattactatgttattactttgctcttacagacatgtgctatacttctgttactagaaattcatctctggagacatatttgttattcaaacaggtgaaaaagttatccccataaaaatatgacctttgtaataaatgtattattcaacaagagttaccagttttctgtagtatagcagacacagcttttggctggtagaaacaggtaagtacatgattaaatctaaagtaataggtactaaagtaatggtattgagattcagagatgggagaaactaggtacacctttgtgtgcatgtgtgtgtgtgtgtgtgtgtgtgtgtgtgtgtgtgcgcatgcatacatgaacacgtgtcatgggagacatgggtagggattcacaaagggattgagaaaatcaaaagtgatggggaaacaagagaaaagaacactataggaaatgacacttaggcatagcttttaaatctgttttcaaacatgaacaaaaattgagagaatgacataataaacactcatgtacctctcatttgcctcaattataagcaatttgccagtctcaaatcatgtaccctcctcagtttttaaaccttattttaaagtaaatacaaaacagaagttttttttttaattattgtagtaagcatacaacatgaaatctacccttttaaaattttaagttcacaatacattgatgctagctataggtagaatgttgtacagcagttctgttgaacttattcctgttgcataactgaactttatactggagcaggtttttcagtttccatgtagttgagcagttttgagtgagtttcttaatcctgagttctagtttgattgcactgtggtctgagagacagtttgttataatttctgttcttttacatttgcttaggagtgctttacttccaactatgtggtcaattttggaataagtgtgttgtggtgctgagaagaatgtataatcttgatttggggtgaagagttctgtaaatgtctattaggtctgcttggtgcagagctgagttcaattcctggatatcctttttaactttctgtctcgttgatctgtctaatgttgacagtggggtgttaaagtctcccattattattgtgtgagagtctaagtctctttgtaggtctctaaggacttcctttatgaatctgggtgctcctatattgggtgcatatatatttaggatagttagctcttcttgttgaattgatccctttaccattatgtaatggtcttctttgtctctttcgatctttgttggtttaaagtctgttttatcagagactaggattgcaaaccctgctttttttttttttttccatttgcttggtagatcttcctctgtcccttttttttgagcctatgtgtgtctctgcatgtgagatgggtctcctgaatacaacacactgatgggtcttgactctttatccagttttccagtctgcatcttttaattggagcacttaggcaatttacagttaaggttaatattgttatgtgtgaatttgatcctgtcattgtgatgttagctggctcttttgctcgttagttgatgcaatttcttcctagcattgatggtctttacaatttggcatgtcattgcagtggctggtaccggttgttcctttccatgtttagtgcttccttcaggagctcttgtaaggcaggcctggtggtgacaaaatctctcagtgtttgtttgtctgtaaaggattttatttctccttcactcatgaagcttagttcggctggatatgaaattctgggttggaaactcttttctttaagaatgttgaatattggcccccactctctgctggcttgtagaatttctgtcaagagatctgctgttagtctcatgggcttccctttgtgggtaacctgacctttctctctggctgcccttaacatttttttccttcatttcaactttggtgaatctgacaattatgtgtcttggagttgctcttctcgaggagtatctttgtggaattctctgtatttcctaaatttgaatgttggcctgccttgctattttggggaagttcccctggataatatcctgcagtgttttccaacttggttccattctccccctcactttcaggtacaccaatcagatgtagatttggtcttttcacatacttccatatttcttggaggctttgttcatttctttttactctttttttctctaaacttctcttctcacttcatttcattcatttgatcttcaatcacagacaccttttcttccacttgatcaaataggctactgaagcttgtccatgcatcacgtcgttctcatgccatggtttttagctccatcaggtcatttaaggacttctctacactgtttattctaattagccatttgtctaatcctttttcaaggtttttagcttctttgcgatgggttcgtacatccttctttagctcagagaagtttgttgttgccagtcgtctgaagccttcttctctcaactcgtcaaagtctttctccgtccagttttgttccgttgctggcgaggaactgcatacctttggaggagaagaggcgctctgatttttagaattttcagcttttctgctctggtttctccccatctttgtggttttatctacctttggtctttgatgatggtgacatacagatggggttttggtgtggatgtcctttctgtttcttagctttccttctaacattcaggaccctcagctgcaggtctgttggagtttcctggaggtccactccataccctatttgcctgggtatcaccagtggagtctgcagaacggcaaatattgctgcctgatccttcctctggaagctttgtctcagaggggcaccctacgaggtccataacaaaatggaggcagaaataaagatgttctttgaagccaatgagaacaaagacacaacataccagaatctctgggacacatttaaagcagcgtgtagggggaaatttatagcactaaatgcccacaagagaaagcaggaaagatctaaaattgacatcctaacatcacaattaaaagaactagagaagcaagagcaaacacattcaaaagctagcagaaggcaagaaataactaagatcagagcagaactgaaggagatagagacacaaaatacccttcaaaaaatcaatgaatccaggagctggttttttgaaaaaataaacaaaattgatagaccgctagcaagacaaataaaggagaaaagagagaagaatcaaatagacgcaataaaaaattataaaggcgatatcaccaccaatcccacagaaatacaaactaccatcagagaatactataaacacctctatgcaaataacctagaaaatctaaaagaaatggataaattcctgcacacatacaccctcccaggactaaaccaggaaggagttgaatcactgaatagaccaataacaggttctgaaattgaggcaataattaatagcctaccaaccaaaaacgtccaggaccagatggactcagagctgaattctaccagagggacaaagaggagctggtaccattccttctgaaactattccaatcaatagaaaaagagggaatcctctctaattcattttttgaggccaacatcagcctgataacaaagcctggcagaaacacaacaaaaaaagagaattttagaccaatatccctgatgaacattgatgcaaaaatcctcaataaaatactggcaaactcaatccagcagcacatcaaaaagcttatccaccacgatcaagttggcttcatccctaggatgcaaggctggttcaacatacacaaatcaataaacgtaatccatcatataaatagaaccaaagacaagttggcttcatccctgggattcaaggctggttcaacatacacaaatcaataaatgtaatccagcatataaacagaaccaaagacaaaaaccacatgattatctcagtagatgctgaaaggcctttgacaaaatgcaacatcccttcatgctaaaagctctcaataaactaggtcttgatgtacatatctcaaaataataagagctatttatgacaaacccacagccaatatcatactgaatgggcaaaaactggaagcattccctttgaaaacgggcacaaggcagggatgccctctctcaccactcctattcaacatagtgttggaagttctggccagggcaatcaggcaagagaaagaaataaagggtattcatttaggaaaagaggaagtcaaattgtccctgtttgcagatgacatgattgtatatttagaaaaccccatcgtctcagcccaaaatctccttaagctgataagcaacttcagcagtctcaggatacaaaatcaatgtgcaaaaatcacaagtattcttacacaccaataacagacaaacagagagccaaatcatgagtgaactcccattcacaattgcttcaaaaagaataaaatacctaggaatgcaacttagaagggatgtgaaggacatcttcaaagagaactacaaaccactgctcaatgaaataaaagaggacgcaaacaaatggaagaacattccatgctcatggataggaagaatcaatattgtgaaaattgccatactgcccaaggtaatttatagattcaatgccatccccatcaagctaccagtgactttcttcacagaacttgaaaaaactactttaaagttcatatggaaccaaaaaagagtcagcattgccaagacaatcctaagccaaaagaacaaagctggaggcatcacactacctgacttcaaactatactacaaggctacagtaaccaaaacagcatggtactggtaccaaaacagagatacagaccaatggaacagaatagagccctcagaaatactaccacacatctacaaccatctgatctttgacaaacctgacaataacatgaaatgagtaaaggattccctatttaataaatggtgctgggaaaactcgctagccatatgtagaaagctgaaactggatcccttccttacaccttatacagaaattaattcaagatggattaaagacttaaatgttagacctaaaaccataaaaaccctagaaaacccaggcaataccattcaggccataggcatgggcaaggacttcatgactaaaacaccaaaagaaatgacaacaaaagtcaacattgacaaatgggatctaattaaactaaagagcttctgcacagcaaaagaaactaccatcagagtgaacaggcaacctacagaatgagagaaaatttttacaatctacccatctgacaaagggctaatatccagaatctacaaagaacttaacaaatttacaagaaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaacacaatgagataccatctcacaccagttagaatggcaatcattaaaaagtcaggaaacaacaggtgctggagaggatgtggagaaatagaaatgcttttacaccattggtgggattgtaaactagttcaaccattgtggaagacagtgtggcgattcctcagggatctagaactagaaataccatttgacccagccatcccattactgcgcatatacccaaaagattataaatcatgctgctatgaagacacatgcacatgtatgtttattgcggcactattcacaatagcaaagacttggaaccaacccaaacgtccatcaatgatagactggattaagaaaatgtggcacatatacaccatggaatactattcagctgtaaaaaatgatgagttcatgtcctcttagggacatggatgaagctggaaaccagcattctgagcaaactattgcaaggacagaaaaccaaacaccacatgttctcactgataggtggtaattgaacaataaaaacacttggacacacggcggggaacatcacataccggggcctgttgtagggtggggagacgggggagggatagcattaggagatatacctaatgtaaatgacaagttagtgggtgcatcacaccaacatggcacatgtgtacatatgtaacaaacctgcatgttgtgcacatgtaccacagaacctaaattataataataataataaagaaagaaagaaactttgtacttactgaacagcaaacaacagactatcttttaaacccattttactctgcttagttttaaatattgagtgcaggtgggagaactagatatgagaagaaccacctttttattattggaaatgaccaagggcattgttttggttaaagtaattttaggatgtttccattgaccattgatatcttacatacatttcctgttttaacttcggagcgagtcattttgaaggattttgctggactttcagaacgtgtgatttgttttaacggtgctctcgggctgccatatgtgtttatgtaggctgtgtcctgaagaaggggtctctgttagggggtatgagtacgctgaaaatgaagcactctccaagcagcacagaggtgcattttctcatctgcagtaaggcatcttagcggccagtggtcctgacagcagcaagtagatctcaaagccatttcacgggccttctcatattcacactaattctaaatcagacttctgttaagaaaggagaaataggtggggcgcggtggctcatgcatgtaatcccagcattttgggaggctgaggcaggtggatcacctaaggtcaggagttcgagaccagcctggacaacatggtgaaaccctgtctttactgaaaatacaaaaattaatcgggcgtgttggcgggcgactgtaatcccagctactcggaggatgaggcaggagactcgcttgaaccctggaggcggaggttgcagtgagccaagatcagcccattgcactccagcctgggtgacccagtgagactctgtcaaagaaaacaaaaaaaagaaagaagaaaggaaaggaaggaaggaaggaaggaaggaaagaaagaaggaaggaagggaaagaggaaatagaatttaacaatttgaacaaaaaaagggggaatagaatttaacaatttgaactaaatacaaataaagtcctttgctgctatcaaaatgcaattgtgacatagagttagtgcaaatatgttattgtgtaatgactgtgcaaattgcttttctgtatgtttgtcttatataatattgacagtactacatagtgtgtcaaaaaactaaacttggtatttttaatgctaaaatgagtaaacactaatcagaatgccagcaggtacaatatctttgaatgaaaataacacattcaaactgctgtttctgttctctttggtacacggtctgcatagttagtatgataaatgcgaatagaattttcatgctgacatttaattaaaatgaaattacctatcattgttacccactacacagaagctattatttatgttgatattattctaatattgtattaagctgatattgaatttgtatcagtgttttttatgaactgaattatttctgattcctcagttgtttttaaaagccaaggagtagatactattgcattgtgcgtggatagagcatattttcctcttatttgaaaagttagaggtggaaatcatgtagttcagtgtaactataattgtactattttcctgtttttttttcttttgtcttctttggctattttgatgccttttaatgcatccccctgttgatgtacagtttaatatctgatataacactaagattaattttttaattgttaatatatctttgactagtctttccctatattattaccattgtgattacttttacttactacgatcaaagtagcaacttgtagtcagatagcagtgatattcacggtctatcaatttatccattcatccatttatccatcctacttttcttcccttcccccatccatccattatgtactgtggatttgcactgaagtcaattggaattaagtattataaaactctattttactaatagccatataaaacccttaagaggcaattcagacattcacaatacttggaattttaacagttacctctattgactattacaatatagcataatctgtaaaatcactctggcaaaaatgtgtatctatgttttagttctaaggaagcaccactcagtacaatgaaacaggaagaaatgctagtgatttacattgttcttgaggaagttaaaaaaaatcaattcattgtgattctgaagctttctctttaggtcagatattgttatattgataacaaagcaatgacaccacacagtttttgtgctccaataaatgtgatttcaaattttacaaataaacatttttcccttttaaaaagtatatacgtctatctgtttagttggacaaatgaagacaaagcaaatttctgtgacccaaatccaagtctgagtactcaagtttgggtttgtacagtttagtttaacttaaaaacaagtgacttgttcatttctacgccacaaatacctaaaacaacaaatattacacatcatttttggttgagaggaatgactaaatcattgtttctagtgattgcttcttatgacaaatcaacattgtttattaaaaatatgagattttatagaggtcaggcatggtggctcagacctgtaattctagcccttgggaagcggaggctggagaatccctcgaagcctggagtttgagaccagcctgggcaacaaagcaagaccttgtctttacaaaaaaaaaaaaaaaaaaaaagaaagaaagacagaaattaggaaagaaagcaaagaaagaaaggaaagagaaagaaaagaagaaaagaaagaaataaagaaagaaaaagattggctgatctgagtgcagtggtgtttacaactaattcatcacaaccagttacagagatttatttgtcccatctctacacctaactccttcatttaactagaaaaatatatatatatattagattttataagaaggaaagtagaacatacaaataatattaagtacttatctattacttgagatataccaactagggaagacagaggaaggacaatcaatataaatcatatttaaacaactactctagtaaattgatcaaagtctggttagtattatctgctttaagtttttctaaggattttcaatgagagaagaccgtatcatttccccacaacccaacctatccagcgtttttctggaagaggctattagcaacacataagctgccagcaatgtaaaatccccttatttgctgccttaacatttgggataaaaagtgttgacaccattattttttaacctcgatctcattgaggaacttcctgaattttctaacatcaatttactgctaaagatctatataataaggagattttgaatgttaggaacctgtgattatgggtgagagttagttgatgagagggtgagagttagttgatgagaggattcgaagctctaacatctcggaataactggtaacacatatctttgcaacatagcttcatttcactgttaggctttggtgtgttggcgattttttatgtgtgtaattaacatattttattgacaatatttatgtatatctgtaattacatatatctgtacaatgtgacatttaatctatgtaggcattatagaaagtttcagtcaagtgaattaacatgcccttcacctcaccaatttatcacttttctgtggtgagaacattaaaactttttaaaaacaaatctgaaatatacattattattatctgtggtcaacatacaatgcattacatcactaaagttcattccttcagtctaactaattctttgtacctctgattaacatcttctcttccctccactcctagtttctggtatccacatttctattccttgtttctgaaatagaccactttagagtccatatataagtgagatcataccgtatttgtctttctgtgtttagcttatttcatttagcatattgttctacagtttcatccatgttattgcaaatgataaaatttccttcttttttaagggtatatagtattccatagtgtatatatactgcattttctgtatgcattcatctgttcctggatacttatattgctttcatatcttggctattgtgaataatctaaaagaaatctgggaatgccgatatctccttgacatacagatttcactacctttggaatatatccagaagtgggattgctgaatcacatagtaattctatttttagatttacgagttactcccatgctattttccaaaataggtgtactaatatactttcccatcaacaatgtacaagggttaccttttctccacatccttgccaatacttgttggcatcagtcgttttgataatagccattctaatgggcatgtggtgatatcccactgtggctttaatttgcatttctctgatgattggagatgtggagcagtttttcatatatctattggccattcatatctcttcttttgagaaatgtctgttcagattctttgcacattttataattgggttgttttcttgtcatgagttaaattcctcatatgacgtggatataaacccctcatcaggtgtatagtttgcgaatattttctttaaatctggtttctctcttcatcgagttgtttcctttgctatgcagaagctgtttagtttgaggcaattccgtttgtctatttttgcttttgctgcctgtgcctttggagttccatctaaaaaataattacccagaccaaagctgtggagatcttcccctgttttcttatagtatctttgtagttttaggtcttatatttaagtcctttatcaattttaaattgatatttgggcctggcacggtggctcacagctgtaatcccagcattgtgggaggcagaggcgggcagatcacctgaggtcaggactttgagaccagcctggccaacatgctgaaactccgtctctactaagaacacaaaaattagccaggtgtggtagcacatacctgtagtcccagttactcaggaggctgaggcaggggaatctcttgaacccgtgaagcggaggttgcagtgaactaagatggcaccactgcactccggtctgtatgaaagaaagagactccatctcaaaaaattatatatgtatatatatataaattgatatttgtatttctagtgatatggggtctgatttcgttcttctgaatatgaatattcggttttcccatcagcatttgttgaataaaatccgtcatttcctattatgtattcttgtcacctttgaaagaaatcaattgatcataaatacttgagcttattttctgggctttctaacctgttccattcgtcagtgttcctccttaatcagcccagtcagagattctaagtgcctctaagttttgtgtttgtccagcctgctgtctttgttcttagtggccccaatacatgggagagtatcaagttgtgctatcgccttgagagacatttgatagaagccagtccctaggaatgtggctggagaggtcggggtgttagatgcgtgttccagttctttctgtctctcttttcagagaagctgagagccagagtttctttctcatccattctgccttactccaaggaatgaagctgagatagatgcctgtacccttgatcatactgctcactttgaacctggggagatacttgttgaatgtttgcaagtttaaaagtcaccttttgttccctgtggtctaggagattcaggagcgtggagttctgtcaactcccagagccaggtgatttaggagccagtcccaagcaaagactgtaaaagttgaagtatttgatgcatgtagaaactgcctccagggagggtcttcagatctatatttactgctgggtcaagctggggaagaaggtgcagagagtgcccacagtcctgcttgagcattcagaagacgccctccctcatagcaggggagacttctggtctggagtgcccactttcctttaagacatgaagaggtctctctgcttccttccaataagagattgcggagtttatctctagagcaagctgagggagaaggcacaggagtgctgtccctcccagtcttgctgggagaagacttcaactcttcacagagagactgcagggctgggattagcactggagaaagccagggaaggccctcgtaggtgctgtgcttcctgtttaggctcaagttggctttttctttattgctttgtaggctcccagagactgacctgttaaaggccaaaaccacagggaactgctgtgaagccaaaccctctccaggggaagggtggaagctggacagatctaggggctaccgctgctgagagtgccctcagaggcagttcaaattcttctttgtttttgtgcttgagggaaatctcccaatgtgctgtctctgacattctgcaagtggggtgatctaagagcccctcccccttgcagtgatggtaaaagttgggcattataggtgtggtgcaagcctgttacccctcaggaagaagctgggagttgaggtttctttccaaatgtaaggcactgtgctcagggtggggttatgcctgagtgtatctccactttttctactcatttgggtgtattttcatagttgtcaggtgtgtaggagtctttgagctggattctggctttctctgggacagaactgatccactcatggctatttacttggtgtgtctgtgggaggagggagcatcaagagtctcctctctgccaccttgctgacttcctgtgttgaatatttttgacttgtgtttatttacattttgtttatacatttgtattttttcaattagtgatactacaattcatgaattctgctttatgctatcaattatgagtagccttaggttaattgctatatttaatttcctgttacagctatagcttcttgtggcttagaattgccttagaatgtaataattctagcaacaaaagaaaatagattgaaatgggccagacagacattcatctgttctctcttttcataaaaaggaaaactaaaaagtgcttataatttgagatattgctgcccatttgaaattataaaaagtctctaaattaagacataactgcttatttctttcagttttttgaaacaaatcaagtaaactatacacagaagatacatgatcatttctctcatgatttaattttagacaatgccttttaatctttttatttcattttaagttaaaaaggccatttgccttctgtattaattattttgtttatcaagtcatctgtaattgtttgtagataatgataatgtattttgaaagcagctttttttttgttcctatataccccaaatgttacttcataacatttttattttatttttctttcttgatcttcaagtgaaagagataaagcctggtgcttccctttcttgtcagttttagaaattaaaggagagagaaaagaggctgaacaacagatgcaaggtcagattaaatgtctcattagagccttttatgcaaatgctgaaccctgcagtcttgaaccgacagacatttcactgtttgggatcctgatgagtcaagtagagacaaggtaagagtcatattggttatttagataaaagacttaaaccaaaacatagggctgagaattaggaccccgggggtgataaaaaattacatattaaaaaaaattatgtcataagtccacccgtggtgggagataactttcatgaagctgtgtttggtcatgagaagttgctagactccatggtggaacatacttaacatacgtccataagatacgtttacgcaaaggataagcaggatgttttctatttataactgtgtcctgtatgacagaagttttaaatgtgttcaggttttttaattttttttttttttaataaaaactactactccaatcactgtgtggcttctccaagcacacctactctttccaagagctatcactctatcagaggggcactgctgctcttctcacccacctacgggaggtcgtcagaggagggacactgaatccagaagcataggggccttgttcaatggggattcattcattcattcattcaatacatatttacaaatcactcaaactaaacactttcaattgaaaattgtgttatgtaccgcataccatgatggataataccacaacttggtacgtcatagagttatgaagattgataaacatttgtattttcttagtccctttttatttattcatatacattttaatatctgattatcatgtttgaatttcctttgattataatgttctttataaatgcaatacattaaaattagaagttagcagttgactttataagaatcattacaaaatttataattattcaaacaacacaagcaaataggtaatcatctatactaagctctaatataagttccaagacaggctaaatccagtatactgccttgtatttttttgtcccatctttctgagaatctttgtataatttgacaataatgtcaagtggaaagagaaataaatccctctttttcttttcctgcatgttgtacctgagagtgttttttccttttctgacactccttttgtatagttctttcagcagtagcaatttattctaataaataggcactcatcacatgatctggaaactactgatttcgtctcagtctgccacaaatacaattaagctgttctgtttccatggttagccatcctgttttctaaaataggaggtttctaaacctctccattttctacaagttaaaaactggagctattcttttttaattggttcttctgtattggatcaaagcatgctatgcaattactgatgctgtcatattggcagaaagaatacgcagaagttcaagctaacattacacatgtcatctttccttgaagaagtacacacagttaactcaatcaaagcaatgtaaagcttgttttttgaggcattgtttccaataaaaagatgaaattggccgggcatggcggctcacgcctgtaatcctagcactttgggaggcgaaggagggcggatcacgaggtcaggagatcgagacaatcctggctaacacggtgaaacctcatctctactaaaaatacaaaaaattagccaggtgtggtggcacgcacttgtagtcccagctactgtggaggctgaggcaggagaatcgcttgaacccggtaggtggatgttgcagtgagccaagatcgcaccactgcactccagcttgagcaacagagcaagactccatctcaaaaaaaaaaaaaagatgaaattaacatttttatcatactattattggatgtaaactagtgattataatgattatgaaatatatagcaaaatggatcagagttttacacatttagttctgttttgattgtttttcatatttaaaataataaagtgttgagaattctactaaagctataaaataaaaagctttcatcttaaaacaatcttatcattgtagatgatctgattttcataccgataaacatgccatgttacttcattgtcaatatattatacaggcaaaataagacaaaatatacgtcacttaaaaatttaaaaaatgtcttataggcttctgaaaatgattaggcacatactatcactttttcctgtgaaataaaaagagatagtctttaatatttagaatgattgttcaacttaatgccttctctccctatttacaaacactctgtgtttggaaaacacacaccttaagcaaaatgcaggtatatgtaaaagaaacagatcttgtttcaagagagaagatacgaagaaagcatttaaaacagtgaatgtcttcaccattactcctcaaatggagtaatggtgaagccggtgtggagggagtgtataaaatttttgtaacacagttggcaatacctgaatacttaaatatgtaaattgttaggataccttagaattcagtatagaaatgttatatataataatcttacataataaagtaatgcaatacataatatgtatgtataatcttaactcttatgaatgctttgtaaatataaccgattgacagccaaaacagtccttggagacagatatctcttctattatcccattttgcagttgagaaaactgaggcacaaaaggtagagtaatacgcccactgtcacagatccaacatgtcttaggggtgggatttgagctccggcaacctggctctagaggtgttggtctcgaatgcctcaatctttttgttctccatgataagatgtggcatcacagaaccctccttatcctctaggtcagataacttttactgtgcttaggattttaatgtctttctaagacttaaatgataatttttccttctcagcatgcatttaattttgaatacatcatgctattgtactctaagtcatgtatatagatccacagcaataaaaatactttaaaaaacttgtcataattacacattgataaagggatttcactgtcatatcatcattttcagaggctatcatattagtataatttaaaatatagtagtaaaagcttgaatctatgtgtctggataagactttctcaacaagagagattttagtagaccggggtacaaattggacaaacaaatgttagaaaataatgctgaagacaaaatatactcaactcacttcttatagcaaatgtgttaaaagtgtacagctcataaatttgaactcacattgttttgatttcttatactctttgaagccaggcttgacgtatggatgcatatttaagatgtgatcggcttcaaacatgaattgattattctgtttgatgttcattaacattaaataatttgagtggggcactgaatctgattgtgtttattttagtgtgtgttagtgaaaacagatttctgtgtagctgatctaatgtaggtggacagcaagtgtctgggctgtgtctgcattcccatcgttcgggcatggctgtgttgtcagctgctgactaatatgtcccttgagtgacaccacagttctgctacatgaagggaggaaaaggcgagttcattcttttgattttacacagtaaacatgccaatttcctcttaatgtatttcataggtaagcaaaataatgtaactgtcgccccccccaccccagttttagtacaaaaataattaaaactccattaatggttttatttggaaacagacatctgaattaatattttttctccattactgcagcaaaaaaagactctgagtataaattgtttaaaatgttgatgaggattatatcattaaaaaattgacatcatgttttgaaattgtcatttttgtaataataaatcatcatatatttaattttgaatttttttctagctataacctgaactttgcagatattatacctctgtagtttgaggttttgtttctgttttgtgtggtgtcctagagtggctgttgtagttatactccaaaaaagatgttaatgcaaaaatataatgcttataggataaggggtataaatagttcactttctttcccttcaggaacaagttacgtaaattcattattatactgaggcagaatgttatacataagaagaagaaaatggcaccagactaaatagtacctcttgaaatgtttcatttattttcatgttacggttacaatgtgaattgatcttccttcccttcttcccctaggaatctgactctatgatcagaactaatttttttcttccctttaagcatactgagggtttggagatagctcctatggttttcaaagtggtggattgatttaattgaccaaaacatagcagggagtagtcatctgattatacaagtataaaataatacagaaagggattttttatttccactgatacaattcaatcaagtttctttgagttgctgagttcaaacattaaagttaaaaaaattcttgatttataaagaaaataaaagttattttctaaatggtttgatttccaaggaacagggaaaaaatgaaatattgttaagattttctgaacaatgaaataaatattgagtattaaataaaagatataatatcttttaaagaacagatatcagttaagggctattaaaattacttttgttctagagttcttatcagaagctctaccaagtttttcagtgtttacaaacagactaacagaccaatttcataataattttcaaaaaaatattgtaaagtaaagtataaggtaacatgatgtgatttttaaggtcaataatatttttaccttaaagatgatgatgcgcttattaggaaaacagtggggtaaaatagggtagccgaaatgaaaccaaagattaaaaaacaaaataaaacaaaccccaagttatcaagtacttaaatggggcattatttcctttgagtatttttattgtcatagaatcagatataaattatgaaagaattaaaacgagaagtttttaaatttgttttactttttagggatggaaagattagtgccattctatctggttttcactttaaaatcgagaacatccctctgagcctttggagtggagagaactcactgtgtggatctcagatccctcttgtttaatttgcctgagtgcttcactgagcttgcaccttcctccacactgagaacaaaagcaggctactgaattaccttttgaagcactacctcctaacagaccccttggattgagaatatggcaaataacagtggctgcagccgccttaaaaacagaagagaatggagtgtggaatgcagacttaacctcagtgtgattttgctccagaataaagcgacatagctctaagtcaggacataccatggggcaagggagtgatggacaaagctaggaaaagagatgttctacacacacacaaagaggttcttctgagtgtggatgcttaaaatctcaagaaggaaaatgtttttcatctgtggtcacaaaggcacaagtaatctagtttaaaatatctagaatggaaagcagcctctgtatgggattagtggctccattatttctttttttcacagcaattttacatgagatctgaaattctttcctttgtaatctaaaccttttcagtttttagatatatcatttaaatatgaaaaaaaattcagggaaaagtaattttattgttttagtacaggtcatggaccttggagtcttcataatggccaggccacatggaaataaattcatagggaaaaccatgctgtaaggacaaagggatctggagtgggttgaggggaaggaaggtattaggtaaccttcactttttattctgcctaaggccaatactagtggtttcaatctagtgacatgcatgttagggcacattttagagcatgtcactgatagctgcctgaaacagccagtatttgcactgtcagataaaagatattgcctgcttcacagtaaagaattcccctttccaggttttaacaggacaagggacggctaactcagatgtatgagctttggtagtacctcagctggtccattaaaaatgtgcatgatgtttagaggcattttatgatttttacaagcataatgttttcactggaaacgtagcagttatctaaatgttcagggaaggttttcttccaggtattgttgcttgtatcctagaatgatttcattcataggtgcagtctcagaatgaaacatacaaatttaaatttgggaaatctattggatcctcttttatttttagggactttttttctcctgtgaataagaggagactgttgtgttcattctcttttttttttttttttttgctggctatgacggtaactgacactcagtaggtcttccctcaatatttgttgagtgaatagatgaaagtacagtggggaaaggaagcagggcataaacacaaaaacggataataatagaggtggtgttaatgacattgaggccaaaatagaaaatttgattctagtggatggtttatcgcatgatacatataatgggttatgaactggaaatcagagggtgtgaatttgcttttattatagtaggagagaggagctgatgagcattagaaaataatgaaaatgagtcattttcttacaaaatattatctttcagataatatagcatcatcagagtctttggatttagagccaaaagagccttatatgccatctaattaaatgtcttatttctaatgtgtatggggagattttctggaaaattacctatatgtgacctaaagtttttggaaatgccgtgtaagaagtttttcttttcatgggaactggaagggataaaaatctgattgcttttcttcagcaaagcataccagcgtccccattaggcaagtgattatgcagtgttgaaaggtattttcttgagaatgttatttttttccttttcattaattatgctttgtctaaaggttctttgtcaaagctctggctagtacttgaaattgtaattgatagggaataaaagaaagtaaaatctttgatctctctctcggtgttatgcaatatctttattcttgagatcaaaagactccgagtataatgctgaccaaacagaggctacagtactgattttgacagagaccaaggacaacagctatgaaagttaacggctatataggcatgaaatgacaaaatcaaaacaaacaaaactgtgagagtgcctctatgctaaacatccttgcatccttacataacataaacagacacattaaaataataaattcataaaataggtacacaatattatccataatatggatctatgataggtccataaataatattgttcaggagaagaggtattgctcttctaggagaaactataggacaagcatatttccaggaaggcatcaaaataaacatttattacagaaaatcctgaaggaatagcttgtacctattcttacagttgaaggcttctagggaaaactggtatctagaacacatagagttccttatttcataataaatgcatcatttattaacattgctccattccctgtatcacttgaccctaagagcaattatgaagttaataaagtttatctttgatgtaatggacatccctttctattctccccagattctttttgtctcaagtatttatttctcgtcatatggcctaaagacatttctcttataaggactgtgcattggtaaactaactctcagaagacttaaagtgacatcatgctttgccactctgggaattatttgaatttaaaatacccttaaaaagataacaaggcttgggcatgatggtgggtgcctgtaatcccaggtacttgggaggctgaggtgggagatttgcttgaacccaggagggggaggttgcagtgagctgagatggaacgattacacttcagcctggatgacagagagactctgtctcaaaagcaaagcaaaacaaaacaaaacaaaagaaaaagagtaaggcttaacctaagaggtctgaaacctaagtagggagagttatcatggggtattgtaaccaatggtgctctcattcagttaagaccatgaaggtacataaatagacacatcatcggtggtagttttgctgtgtgattcctagccactctcacaaaagcttcccctgtgtctcctgtttaaattgaaattagcagtatctggtacttttctctagacgtagtagaaatacttagatggcagaggatttctacttcctttcagtattacattgattcctgacatctttcagtcagggttctttgattaaagttgaatcatctatcattttattctatttttaattgctttgctttttctaataaatatatattcccctcttttaatgatatcatgaactttgaaaatgtttcttcctttgtccttccaaaaattaacttatttcagtagggaaggctacaaaaatattggaagagtaattatatatatatatatgtgctgatataaaactattttatcaaaaccaaaacgaaaacgaacttgaaaatcaattatataggaatatgcaattttagtataagaaaataggaagtcaaaaatcatggatcattacttaataaaacaaaatagtaaaaatgacaatatagtttttttggatacagattcccactctgttgcacaggctggattgcagtggcacagcaatggctcactgcatcctctacgttctgtaatcaagcgatcctcccgcctgagcctcctgagtagctgcaaccacaggtgcacactactaccaattttttgttttttttctttagagaggaagcctcactctgttgcccaggctggtcttgaactcctaggctcaagaaatcctcctgcctcaacctcccaaagtgctgggattacagacaatatacttctaatttatatttgcaaaacatcaaatgtaagacaattagaaagtagaaaaatcttgatgagttttaaaaaattataacataagtttcttaaaatgtacaatatatgtacaatattaagaagtagtaaaaaagtcatatttctgactttgtgaatcaaagccaatgtattcaacttgcattcttccccattttgcatataggtatttctccggccaatgaaaacctacaatattcagatctacatggcttactgaatattgtctttccttttgtcctgttttacatatgtttttatagccccttgtataatttctatttagaatctcagttgaaaaactgaaggggaaaaagacagacagatggacacgcccccctatacacacacacacatgcacacacacacagggagagagagagagattaaatatgaatatggaggtgaacataggcaggactggcacatgacaggtatttaatgcatcatttccttacttccatatttctttccatcttccttcattcctactttccctgcttaagacattttcaataaaaaaaaactttaacatttaaattgggtcaacaagacacatcatgtgcacatagtttgggtaataataattaacttcacggttaaatatgacatgatatgatgacatcagacatgtttattaagatgttgtctagctatccatctggccacaaactgagcttactttaccagtcttcaaaagaattgctcaggctagaaaaatgttaatttccctgtttatgttgcttaaaccctgaaaagttatattctaactaacagtattaagatctaagttaatgattctatctacaattataggtaattattaagtgcttaatgcaatgctcagacatggtagatctaacaaatattctcactgttcaatttctcaaaatcctattttactaaagatcacacacacgcatacacatacacatgcactctcacacacacatgcctgataatgcagaggaaaaaacatatttgtagtgatgccagtggaaggactgttgcattaatttttcactcatttatatacacgattcagaaaatcaataaactattcttgtttgttttctcaaagtcttcaaaacgaattaatgcatttcaaagttttggagctagccttgcatatctcttttcctgaatgctcctgaatctttattccatgtcagagctttgatgaatcagttacatgacagtgaatgccatttgctgatagcaaatgaattcaaatagccctcaatccatgtaggacaagactgtcgtatacttcttggtactattccttgtgttataaaattgaggtaattgagcatttaatatcccatttacaattttgtgtatgttgatgacacaccacagccgcaggaagctattaaagtgcatagacaggtacatacaccaatcaaacttttgccacagaaaagcatctccgtggatgaaaagagtggcgactttttattttaaattatgacagctctgggcagcactactggcagccaactcacagaactaatttactatcacctttgtgatagaaacagcttgatctaaaatttgttaactatgtaaccagttggttaacatgctgtaaattggatgttcagttcttatggaaggaaattcacatttcatttattatatttttatgtcaattatgtcgaagaaaatatttctcttcctatgcaaataagtaatctgatatatttttattcccccagagaaaagtataaaaatggaactattgccctgtagaatattcaagaccatggtgccacttattttatactgcaagtagtaaaatctgacatggtaataatatagatagtaaaatctcactgggatggagggatcaagggagaaatttcactaattccctaaacttaattattcaagggtatttgaagaaaaaaaagaagatatttaatatttataggactccatggttccatttcattcagtggagcttacacaaaattttgatttaagagcaatctgaactagtcaaatagtagactgtactgtaaacaatatgctatataactgtttgtatacaatgaagtggtaatattggttaaacattaaatttacaagaaaattagcatcaggcagatggcagaaggcaactcttaagtaataaacacaattgtatatctggttgcacagaaagaatgaaactttgataaacacaaattctcttctgttcattctgcaaaatttcacaactgtaatagaatgtaactcctgaaatactacaaatgaaattaaaatttgaaaagccacatccatgacttacagttcatctagcaagcagtccatacattgtttcattgcttatcaacaaatgagaaagctataaatgcccaatgcattttgaaggtcaatttttatggtggcataattttaaactagctcatcctcagtggcttttgtaataaaaagggataaattaatggccccttaactaaagtgaacttttgatacggaaacaaaaagaatattaagcatgtcctattttaagtagaaggattaagagctttattccatgaaataaattgggcaggacctaagattcaagactttgaattggtttctaggacattaacataaggagaacaagagaatttgacattgctagaaagaggcacaaaaggatgtagtatctgttagaggaaagattttcacactagctgacagtaactacaggacgtatggtggactgaagtgtttttctcagtttaatctgtgtcttcaaaaggcggcctcaacccttgggccacagaccggtactggtccatggcctgttagggacgtggctgctcagccggaggtgagcagcaggcaagtgagcactgctgcctgagctcagcctcttgtcagatcaacgatggcatttagattctcataggagcacgaaccctatggtgaactgcacctgcgagggatctaggttgcgcactccttatgagaatctaactaattaatgcctgatgatctgaggtgaaacagtttcatcctaaaacatcccctcctgtccatggaaaaattgtcttctatgaaactggtccccggtgccaaaaagtttggggaccactgttctatcaaaatatcttctcctttgtttttccagctttattgaggtatgatcaataaagaaacaacgtatatatttaaggtataaaagtgatatattgataaatttgtacattgtgaaaagactacgacaagttaattaacacatccataattcacttagcgacctgtgtgtgtgtgtgtgtgtgtgtgtgtgtatggtgagaacacttggaatgcattctcacagcaaatttgaagtatacaatatatcattaactagtcactacattgtatataggtcctcagaacttgttcatcttataaatgaaagtttgtactctttgaccagtatctcctcttctctccagcccccagctcctcctaatcaccattctcctctctgttaccaagaatttaacttttgctttagactccacatctacgtgagatcacgcaatatttgtctttctgtgcctggcttatttcactcagcacaatgtttgtcagattgatccatgttgtcacaagtggtatgatttccttttttactaccgaataatattctaaagtttctataccacattttctttaccaatttatctgctgaaggacacgtaggttgtttatgtatttggctatcatgaataaatgttacagtgaacatgagagtgcaaatagctcttcaagacactgattttatttcttttgaccatatacccagaagtaggattgctagaccatatgggagttttatttttcatttttaagaaacttccataatgactttactaatttccattcccaccagcaggacaccagggttcccttttctctacatcgtggtcaacagccatcctaacaggtgtgaggttctatcacattgtcatttggatttgcgtttccctgatgattaataacaagacatattctccttgccaaaattacaaccagaccatttttaaaataactttaacctatcatgttccaaacaaaaaataccatcctctccataagtggctatggaaattatttcttcttttctgttctttccctttttatttgtgctcacatctgacatatatggaggctagctgcccatttgtatctttgcccagtattacttcaagcgtgagtgttcatcttactcattttttaaaaatatattttgggagtccagcagaagtcttgcatatagcatgtattaaataaatacttgctggctttaatttggtttaatgttgccaagtgtctttgccaatatattgccagtcactttcacttgaaaacctcagcttcgatttttattatgtcagtttctctactctcttgttatgtaccaaattctaatgatattttaagtcagttctattctcaccaaccagccttttcttttaacacatcggtattactgcaacactttctagctgacctccttgcccaacctaaggttcttctaacttgaaggcattctatgtacaactgtggtactgaatagccacattacttccctgctcaagcattatataacgagtcttcactacctactgcatcaaagtgtaaaattatttcccaaattttatacccccataatttagttttttatttttctccaactttatttttcattatgctgaaatattttcttcgttaaaaatctcatttattgattcaacaagtactttctttttttttttttttttttttttttttgagacagagtttcactcttgttgcccaggctggagtgcaatggcacaatcttggctcactgcaacctccgcctcccgggttcaagcaattctcctgcctcagcctcccaagtagctgggactacaggcatgcaccaccatgcccagctaattttgtatttttagtagagacagggtttctccatgttgatcaggctggtctcgaactcccgacctcaggtgatccacccacctcggcctcccaaagtgctgggattacaggcgtgagccactgcgcccggctcgacaagtactttcttatcaccagtaatatgacaagcactgttttagattctggaagcatcacaaagttcctgtatcttttttgaaggtggtgatatgggtggctataaaacaaacctgttctcacagagcacacaatcaattgtatgtataaaaattactaaaatatgtcaagtggtgataagtgctatgaagaaaagtaaagtatgatacaaggacagagaataatggggacatggagggttttattttatttaaagtgctcaagaaaagcctttctcatacttcaatgaagggagaaacaaaccatacatatatctggttattaaacttttcatcgaaagagaacagaaagaccaaaaaccctgaggctggtttatacttggctgttggaggaaaagcaagtggcgattttatggtggcttggattaggatagtagcgacaaaaatggggggaaatgttaaaggcagctacaatttttaaatttgcctattggcagtatgtgctagtaatatattacatgtccgggccagtacagggacctcatcctttcttttcaattagcccaattataattgtgatgaggatttctggagaaaagtaatactatgctttaatgattctaaggtctaaaatataaccaaattgcctgtaagatataagcaatgatcagaaggtgttgttcaataaccaactatcatggccgggcgcggtggctcacgcctgtaatcccagcactttgggaggccgagtcgggcggatcacgaggtcaggagatcgagaccatcctggctaacacggtgaaaccccgtctctactaaaaatacaaaaaattagccgggcgtggtagcgagcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaataaaaataaccaactatcatataaattattcggccctttattgagtatattccatttatccagcagtgtgatttctggctgtctcagttattcagtatataggctcagatcagagtaagcagaagaggactttgaacatcagagagcagtcagaactggagaatctacttgcagatgagggatttattacaggtctagtgactcattgctgtttggtatctcatcctccaggggtcctccaggtggtctgggtttgttgtgggatggtgggttctgggcatcatactttctccatggctgctgattggcctcagagccagtgttccaaggaaactcaaaaaaaaactgcagggtctctgccgacctcacctctgacattccacatcactcctgctgcattctgttggggaagcatgtttcataaatagaaattggactctacttgtcaatggaaggagtaacaaagaatgtgcagtcatctctaactggtcacacagataatgcagaatttaatgttaatgcagtagaatataattattacatacgtgaaggtgcttttaatgtttctgagaacaagttaaagcatgttcaaagaactgtttcactaaaggaagcaggctatcacatatttttaaaagattttcattgaaaaatttaaaagtaatctttaaattctcagttatttattaccacgtacatatatatgtatgtgtatttatgtaaaaatatatatacatatgtgtgcatgtctatgtagatacacacacaaatatatatggtatatttatgcaaagatcccactgataaatacatgtatctattttatttattaaatttattatataactaaatttaaatttctaaaaatgtagtaaaatttttattattgaaggcccaaagtaactcaaactgttaacttttataatcgaatgcatatttttatcttgggattgtttaattttaaaactatttattcaaaaataaacatataaaaataatagtaaaactcacacattcatactgtttgtttctgctgtaaaacaaaattggaaacaacaggaaattgattgcctaaaggaaaacttaaattaaatataatagcttaactattatgtgagcagtaataaagttgaaaatgcatgccctttgttgtaggactttgagccaactgttattttcattgaataatttctgatttatttatctagtcaatccgaaatcagcagttatccttagaaatatgtcacatattctattatctccaagcatgaattatcagatcttagagaaatttccaaatagaaagctatatctatgaaagtcaaagtgaatcgttaatacaggcttccattgtctataaacaatgatcacttgagaattaactgttcattaacatgcttcatttttgaagccaacagtaaatattatttaacatgaaaataatttttcagttttacttttttggatcctagattcttgtctgatttttacttgtgaaacatatccctaacccagaaagtatcattctatgcatgtccaaatttactatgaggggtaaatgaattaaagtgctcccagagggattagaacctgagggcaatttcttcttctttttcttcttctatttttttttttttttttttttttgacaggtctcactctgtaacccagattggaatgcagtggtgcgatctcggcttactgcaatctccgcctcccaggctcaagtgattctcctgcctcagcctctcgagtaggtaggattataggcgtgtgccactactgcctggctaatttttatatttttagtagagatggggtttcaccatgttggccagcctggtcttgaactcctgacctcaaataatccacccgcctcggcctcccaaagtgttgggattactagcatgagccacgatgcccggcccccatttcttcttgtagaagaatagattacatcaacctgaaactgctttaagagtcaaaatgatgcagctattcttgcaatgttgggtgatcagggtgatgattgtaatttacttttgaattttcaaatgttttgttgacctaaactataagtaaagatgcactgctcagagaagccagtgaatatcagagtagaaacacaagcctgttatctcatgcccggaaaaaaagtaagaattaagtatgttaacttcttagactataacacacatttaatttctcactgagtattagttttccatggtgcatgtttttatgtaaggagaggaaaaatccattttcaaatccaagtcacatttctctcttagtaatcatattattaatatcagttaaggagtattttatttaaggcaacaagtgttaaaaaataaattcctaaaggtgtcatggctcaaacatgatagaaaattatttcttgctcatttacaaaactggtactttcggttggtaactcttttcaaagcaataattcaaagactctagctcatttccccaatgtctatggaatcctcatcattggcttctaggatcaccatgcttatctgtactagactgaagaaatatggagaattgtgcctggaaagttttcaagggtcagtcctggaataaatgcatttatttaaaactcagtcacatgaccatacctatctgccaaggttccagaaaatataatcctgatccatgactaggaagaagataaaataagtttgatgaatagttacccagtctccaccatagcagaagaagcccattctatttgagattcagagatcggcaaaataaactcagtaggcaagaggcatagagaaggttggaagtcctatagcagcttaattaaagcgccctggccgggcgcggtggctcacgcctgtaatcccagcactttgggaggctgaggaaagcagattaggaggtcaggagatcgagaccatcctggctaacacggtgaaaccccgtctctactaaaaataccaaaaatgagctgggcgtggtggcaggcgcctgtagtcccagctactcgggaggctgaggcaggagaatggcgtgaacccggcaggtggaggttgcagtgagccaagatcgtgccactgcactccagcctgggcgacagagcaagactccgtctcaaaaaaaaaaaaaaaaagcatccaatcagtctccaacactcaagaattatttgtgagattcttatagaactaaaatctgtcactagctagttctcctgtcttctttcatggcacctgagagtttgaaaaataaaaggttatgaattgtatgcatgccattttttttttctgtattgtatgcatgaaaccatcaaagatggaattctttctacctgtagatatccatttctcctccaagagatctcaggtcccatgacaatgtcaccacttctgctcctcctctgcaagtgtaatgaagagggtatttcagtggaagcaatgtattactttccctctcttggattatgacttgaaagaataacattcacacatttgtgaacctgttcatgccccacttcagttatcagtattattcctcattgcttccctgcacatgtaggttaatatcctcactcaccttttctattcttgcaccccttccatgcaggcaaaatgttatacagttttcaaccctcattgatcacatcccaaactccctccactttgatcacttgtagtagagtcagtgtctctcacccataagactttgagttctcattaaactgtgaagtcagagcttattacatttttatctttgcatccctagtacctagcaaaatgtctgccagtggccaaatgctcagaaattactggtaaatgatttgaagatttccactgactatgctggtctaccctgttctgaacttcacatcaaaacctatatgttgagagttttcattatgacaaaaatatactgtggtcaacatcttgaatgtagtgttagttatgatgatatataccgtttctaaaatttctccatatgcacattgaaaatgaatacattttattacatgtaaattcttaagagatgtaattttaaaaaagagctactgaaatgctaaacaagacagaaaaatgtccctcgagattcttgctattgagctgacgaccaaattcaggcacttgcagagtagttgaccttctcttaagaaggagccctcctctgtgccctcactataagaaggagcctcccaacattagattttctcttgaagagccctttggactgttgttctgtctgagagctactggagaatctctttgatagctttgcttttgacggttttctctggagaaaggtctaatagaagcaaacagttaaaacccttttccatccttcacgttttttaaaaaaagtctcccttttaatatgattttctaactctgtagcttctttgtgtcattttgttcctacaagtgttcatatatacttttaggtcacatgcatttccacacacaatctgaatgtttcctacaccatagagaaggtgttagagactggatacttatacaatgttatttaggggtcggggaagagggagactctattccttaaaacaaggaacacaaaattaaaaatataaaacatgatataaaagtaaatattggccagggcgcggtgacccactcttgtaatcccagcactttgggaggctgaggtgggcagatcacctaaggctgggagtttgagaccagcctgaccaacatggagaaaccctgtctctactaaaaatacaaaattagccaggtgtggtggcacatgcctgtaatcccagctactcgggaggatgaggcaggagaattccttgaacctgggaggcggaggttgtggtgagccgagatcacaccattgcactccagcctgggcaacacgagtgaaactccgtctaaaaaaaaaaaaaaaagtaaaaacaatgtaaatatttatctatagtgagacaagtaatcaaaaccaaaatatggaggcttggagatataggtccctttcttccaggagctctcggtaatttactagaaatgcttccacagaaatacttttgatttaaagatagatttttctttcacccagaactttctctaagttctaccaaattatctcaatttgattgtaatttaaatggaaaacataaaactacaaacttttagaatataacatcgaggcacatttttgagccccagggcctgctgacatgttcttagacatgataccgaaagcataatccataaaggaaaaaaaaaacagaattaattggactttatcaaaactaaaaatatttcatctacgaaagtaaaaaatgtatgtatgcacaacaatctgtacatgattgttcacagcatttctatttttaacggccctaaactggaaaaactaaaatactcctcaataagtgaatagttaaacaggttgtggtacatctatatcatgaaatactgctcagcaaaaacaaaagaagacctaacaacaagaagaacaacaaaagtgttgttagatgcaccaacttggatggatctcaagggcagtatgctgagtgaaaaaagccaatctcataaggtcacaaccttcttgaaataaagacaatacagggattggaaacagattagtggtggtcatgggttaaccatggctgtagtgcagggagaggatgggtctgagatggaacagttttgcatttagattgtggtagtgcctataccttacacatgtgattaactgatataaactatatacatatattgtatcaatgtcaatttcctggtttaaatagtgtgctatagttacgttaaatgaattcatggcagaaacttgatgaaaagtacccaggacccccctgtctttgcaccttctagtgaattcataattatttcaaaataaaaaatttaaagcttaaatgttagcacttacacaagtggattactttattacttctgggatatgtacaaatttgggtcctcttagtgtctccatgattttacatgaggttgttctaacataaaaaaaaaaaaacaaactacgtaaagagtgtttttaaaagtgagaagaaactactgctagtttgagaaagggctagatcctaatcagtaaatagaaaatcagttaacattcaaatcatgtttaattattttatcttggaatgcacacgattactgttttattttttactttttagagacagcgtctagctctgtcacccaggctggagcacagtggcatgaacacagctcactgcaacctcctcatcccaggctcatgtgatactccaacctcagcctcctgagtggctgggaccactggaatatggcacatacctggcttttttgtttgtttgttttaatttttcttgtagagatgaggtctcattatgttgcccaggctggtctcaaactcctgggttcaagcggttctcctgctttccagcctcccaaagtgctgggattacaggtgttagccaccacacccagcctatgattatgattttattcattagtctatgtaccaatatttaaaagaagaatttgtatcttgcatgtgtgcacaattataccttacacataaatgagtttgaaatggtaaaacggcaaacctctagactatgacagccaaagacaggtatttgatccttgaaaatagaaaataatataggcaatgacttttgcaaaatagtgagatatttccaggtaacatttattctgaaggatttgctttcctatcactgcaaagatggccttttcaaccctctcaccatcatctcatttgctgagatgagagagaggagagaggggacaaatggatatacagatatatgggggctgggggagacagagagaaactgtgttttctggggcaggcataggtaacatttacagatacctgtccaaagtacacacatatatttctatagtcctagcattgcacacgtattactctaaaatgctggcattttctgtcaatctgcttggtagcaaatgctgaggaacaaaccaatcactggatctaggagccaagaactaacagagactctgtgctttatgtgtgagcatttaactactgtagatggagacctgcacgtatttaaattgaatatcagtcctgtgtaaagagtgattattctgatgcttctccgcatcagatataaagttatatggagtccaaagaccatcaatagaggattactcgtagcccatctaattttggaaaacaatagaggagttttctggtgtgaggtgaacagcctgctgttttctttgcctggaatgcattttcctcctcttccatgcttcacctccactccccttacctagttaatacccactcatggctcaacatttgctcagctggtgtttacctacgaagccttcttattccttagatgaaaataattaccccatgttccactgcccagtcagagttaaacagaacttctttttttttatttttctttttaagaatatagagtctttaatgtggtcagaattaagttgctatcagtttaaaatagcctgttacaagtgtattttatataagcctcatagtaaccacaagcaaaatctatattagatacagaaaagattttttttttaaaaaaggtttcaggccaggcactatggctcatgcctgtaatcccagcactttgggaggccgaggtgggtggatcacctgaggtcaggagttcaagaccagcgtggccaacatggtgaaaccccttctctaataaaaaaatacaaaaattagctgggcgtggtggcaggtgcctgtaatcccagctacttgggaggctgaggcaggagaatcccttgaacctgggaggtctctctgtctctctcagtcattatctctctcttcttcaaacctgtaacaaaactccataaggaaagaaatttcattgtgtttgtatttgtctccatagaatctagtataatgctatgtgtacatatgtacacatatgcgtgtacatacgtgcatgcacacacagacttacatacacagggcttgcagaggaataaattctgcttttaaattttctatttaaaaagatacttcaaaattcccttcaaatttgatgaaaccaaaagtttgatttacccagacgttgaggttttttcttttatgggatatacaattattccatagtgacatgtcctaagataattttcatattcatagaggaggctgaaggtaggattttgtgaatctttgataatagttacatgaatgttgaatgtttgtatattgaacttgcatattctattaataccatctctggaaatagggtcatttggttataccaagttttttgtatttacatatttcaagaatatctatttaaatatatgtaactagagctactggcagataacttaggtctatatggaaattatgaataaacaaaagtagatgtgaatgaagccaagaaactcctagtgatataacatgaagtctttactcaagctttgtttagaaccagtaacaggggattttactcttttcgtgcaatggtccatttgtcagtctaattaaaaaaaaccacaaaacaccctcctcggagtaatataatgttattaaatacataaaatgaaatacagcggggcatggtggctcacgcctctaatgccagcactttgggaggccgaggcgggcggatcacgaggtcaggagatcgaaaccatccggctaacacggtgaaaccccgtctctactagaaatacaaaaaattagccgggcatggtggtgggtgcctgtaatcccagctactcagcaggctgaggcaggagaatggcgtgaacccgggaggctgagcttgcagtgagcggagatcgcgccactgcactccagcctgggcgatagagcgagactccgcctcaaaaaaaaaaaaaaaaaaaaaaagaaatacatagggttgaagagagaaatgaatcatattgaaagccaattttaactcaggagacaggataacctttttttgtttgttgttgttgttgttttttttttttttttggttaagcaacttggctttcctaacatctaatacttttcaaagttttccatatttgtttgctgcttatgaaaaccaaattaatgatgttttttcctgaataatctcatcatgaccttattcttataatgaaagaaaacagaatgctaaagctagggttgacagataaaatatagaacatagcttaattgaattttagataaataatttaaaaatagtataaatatgtaccaagtattgcatgggtcttactaaaaatttgttatttatctcaaattcaaatttaaatggacatcctgtatttttatttgctaagcaggcaacccttcaaaaactggtctaggttaacaaatgttagcgataaaattgccatgatcatgccctaaggaagtagaatcggatctactaagattcttattttatctccgcctgaaaaatattagccttatgggttggtttcagacctgtccctacatcatattttatgagttttgggaaggcaaatatttgctaaaataagatttaattctgtgctttaatgttttattgatgataatataaaagtggtaataaaagaatacttcacttttgcaaaaggcaattgaatatactgactgatatttttccagaaagtctgtctagttgtagtgacaagaagaaaatatctcttcctagattatctattgaaattccttttatcagcaagaaagtgtaattcactacgttttctcttttgcctttctgcaaaaggctaagagttcagataataatgtttaatagttattaaagtgaacttatctatccttttgtttaaacattttgatacatgtccgcattttattttcattttaactatcttattttattcatgttatttttctaagcctgatcaatttttacagaatgatcagattataagtcctaaatgaaatgccactaatttgaatcatattcagaatgtaatttgttaagtaacaaattttacaagaaatgtgatagatcatgcaaaaattataggtcttaaatcctacatatctcgaatcaaattattttaatactaattttcattgcaattaaaggattcagtaaggattgtaagtactttccattatactgaagacttggaacaagttctgattattacatattttagcatagatgacaggatgcatgcaatgtatcagcatgtaaaatgaaggaaagatagaaaaacagttgcgacaattttgtgcagtagtactatcgtgctgctatacaagtaaaacaatttaatcacacataacatagtaataatgcttacttattgctagaaaaacaggattttaattattttaatgataaatctgctttataattaggcagaaaagcaagctgtgaaaaagcaactttagtatttaattctagtgttaatttcaaaaacaaaaacaaaaaaaacccctgaaaaacaaaagaacacaaagacaggttgaaatgttccttttagggtattacatgctgtacagtgctttgtagtttaaaaagttttatgcccatgcctgaatgcattttgattctcaaagcatcttttggggtaggtttggcaggcactattgttcattcctacaaatagtttaaaatttttaagaaaaacattttagtactttattgaaaatcctatatttgcagccttcattcttaatgtttgtagcacattgaattttattgattgtaagacaaatttatttcaactggattgttgaaataaactctaaataactctaaaaataaactctaaaaatcatggtcacggaggttgagtcagattatgcttgccatttacctgtgcatgtgcaaacctcaaatacctcagccttaaaacttggagaatgagtgttcctgtggaagattattcttcagagatgatagtggagtactcttgaaaaccctaggtaccaaattgctgcagaagtatttgaaggacctggtgaatctaatatgttttaccaacatactacaagttgaaatcaaaagttgactgctcgtacataattgcaaagtcagatgtcagatgccaacatcaaaagctcttcaaaaataccacataaccaatgctctttgtaacccaagggatgacactgtgtggaaaagcacaaacatcaagaactctaaacctaaaagtgatttagacaagttaaattccaaatgtgaagtaattatagactgttaatatatttgccttataaatttgtatgtatatgcatgataaaaatctatcactaattaagggtaaaaaacttgcaacaaaaataagctttctagatattaaaaagcatatcatttaattgaatagatgttttccttcttgttacacagaataaggtgtatctatgtaataaagacgtgtaggatttgagtaatgctgtgctaaatacttactatcttgagttctggtttggagctatattgtcccatttatctgtctgtcaattcttatgctagtaccacaacatttcaattattttatgcctgtaagacatgctaacattttagggtaagatattatttctctattattcttcatttgcaaaattcgcttggctattatttcatattagtttttcaaatgtaactgcagaattagaatgcagaattgcttctcaagcacaccacactgtgcagcaagtgaaactgcactggagtcatgagcaataggcattttccacacttgggatctagaaacacaagatgcctttccattttttctgtttttcaaacgttactgtgtttggtaaagaaggttgttttttttttgtttgttttttgttttctgctctgggctatatatctttcaatgttaactttattctctaatagattatttcttctgcttattgctgaaagatgaacaacaaattttatgaagatttgtgtaagaatagtggatgaaaattttggtagatgttagcatttgcttatttggaaacacacgcttagagaacattcccactctgaccagactagaaatctgaggtttgacaagagtgacttaatttcacaccttctctctctgtcttttttttttcgtgtaaagaaaacagtcatcagcataagatttaaaatcttaaatgtacaatatgtttgactcatctgatacgttccgcctttgctgcaatggccttcaatacagtaaaaataaccacactcatgcgttagaatcatctgtgcaaactaaagtatatggcaaaattttaaagaaatcaccaacttcaattaatttattttgaaagaaagaaaaggaatttgcagtaatacttgaaacatttaaaatgaggattttttaaaaatatgctattaaaaatatgaatttatttaagacaatctgagatgactgaattataaattgtgtaaaaggcaatttagaatttttaaattatcaatgtatgtaaaatataggatatttcatttgttgcattgttaaattattgcttattttttaatagcataaaataaagtaaaggctatgttttagaccaatgttagtttttactcttatctatatataattggtaaatggagaaaatgtcagtgagaaatctaaaatcaaaataagatatgatttttaaataaattgtacagtaatttttctgttgaaattatgaacaatataaatattttatcatagttttctgtagttttcaaaatatcatatttgtggatataacccctgtttaatcataaaaaattataaatgactaaagataaaagaggaaaggaaatagagaagaagctattgtaaaaagaattgaaaagcagtgttttcctgctatttaactttgaaacagaaaactttttttgttgcaatgattcttcactacaataccaaaattctgaagagaatgttttcaggttaccatatcaccaaatcagcatagccagagaccaaacagtgagctctaaactatctttactagatttgaaactccagcatattatatttaccaaggtaaattatccctcttatgacaagtttttgttatcctaactgataatttagaaaactaaaggtcatttagtgtaaaaaacatagttgaaatacaattactttctcatatgtatcttaaaatgatatttcaaacttccttatgcagtgttgctatctgttaattctcccatatatcttattgaactagctttttttttttttctttttctttttttgagacacagtctcactttgtagcccaggctggagttcaatggcatgatctcggctcacttcaacctctgcccccaagttcaagccattctcttgcctcagcctcccaaatagctgggactacaggcatgggccaccatgccctgctaattttcatatttttagtagagacggggtttcaccatgttgggcaggctggtctagaactcctgacctaagggatcagcccacctcggcctcccaaagtgctggattgctggcatgagccactgctcccggccaactagctttaactagaatattatcttcagcctggcagttaaacaatttagtccagtagttacataccttaagaacatttagagaaaacaccaaaaaattactaaaaattctggtaaaattaatacccatgactagagatatgaaagtctggcattaactaagttgagaaagagctgttggaacagtctggagaataatatgaaatgttagaatgcaaggtcaatgaacagatggttctgcatttttatagctaacactactaattggaatggatttaaaatttagcaaacagagttcttcaagtgcaaattgttaagaaagagaggcatacattctttctaagtggcttggtggttgtacttgattattatggactggatgtggactagataataagatataaaattgacaagagataccatggcctgataatggtactcattttttatgtgtatgcataatttaagctatgtttttcactcatatgttctaatcactttgcattttttctcctgtactgtgtgggatttgagagtcgaggtgaaaggaagaacccaaacaaagagattgttcttaaaggcatgttagggtcctttgggttaattatacaaggtttgctgacagcgcctgataagaccgttgaggtcattctgttgttgacgtctcttcaatctcaatacgccactcagcaaaggccaaggcagatagagcttttccactatctttatagcacaaaatgctacgctgaagagagaaaacacacactctctctctcattcttacacccacacaaaacctgagaagcccaaactgccacacactttgttgatgacaaggtcagcatgataccttagaaccattcatttctttccactccacttcactttcaatatgcaattttaaacatcataatttttaccaccagaatgttacaaaaaatgtctgctaattgctttgtgtccaaaaaagaaaccaaaagaaaatggtattttgctttagacactaacaaaatgtaaagggtaaatgaagctatgtcttagtagtatggcagaggcagaggagcagggcaagaaacggtatgtaagacacgaactagtcactagtctcacagttctactgaaaagtgagctttatctagttgatgacatcatgcagccccatgaataataaatgaatacatatttattgagtgcttattaagacctccgcaaagctctgcctctgtataaatgagtgagatgaaagcactgttctcacaggaaggttataaaggagctgggggaaacattaatgcaagacacagatcataagagagaaacttcatagtaaaaacgataaagaacacatgagttcttccagagcaggggtccccaacccctgggccgtggacctggtacctgtagtggcctgttaggaaccaggctgcacagcaggaggtgagcagcggtgagccaggaaagcttcatctgtatttacagccgctccccattgctcacattaccacctgagcttggcctcctgtcagatcgtctgtggcattagagtctcacaggagagtgaatcctattgtcaactgtgcatgcaaatgagctgggttgtgtattccttgtaagaatgtaactggctgggtgccatggctcatgcctataatcccagcactttgggaggctaaggtgggtggatcatttgaggtcaggagttcaaaatcagcctgaccagcatggtgaaaccctgtctctactaaaaatacacaaattagctgggagtgattgtgcatgcctgtaatcccagctactcaggaggctgaggcaggagaagtgcttgagcccgggaggcaaaggttgcagtgagcagagatcactgctctccagcctgggtgacagaagatcactgctctccagcctgggtgacagagcaagactcggtccaaaggaaaaaaaaagaaaaagagagacagagagaatctaactaatgcctgatgatctaacgtgggacagttccatcctgaaatatttaccctacacccaagtttcatgggaaacccatccctgctgccaaaaatggatgggggctgctgctccagaggaccgatagtgcatgaccattaatctgtgtcatgggagaataaggtttttttgtttgattgttttttattgttttttattttatttttttttggagcccccttctgggcaagaaagaaagggatcgatgaaaaatatgcctcctatacagaaccaagactaaaagggtcgaggtggaataaaatgttcctatagttcgtaagcagccgtagtttggagtgctttggcatgtatcaatggaaagccaggatagtgtggttaggaatccatactctgtaaaaaaaaaaaaaaaaaaaaaaaccctgcctgtgccatttggcatgcttagttcaattattttgaatgctataaaaatagagatggaggagaaaaaaagatttcaaagtaggaaatgaaataggaagaatgttcaggcagagattgaggcaagaagggagtagagcccaggcagatcttatcaatgtgaatcagtctcaccataagtcctaacttccctgttgggaaagcaacagctcaaccagagaccagaatcataggttactgaaattgaagggcccagagaagtcatcttgtcaagcttctgcatcttttttatctcatggatcctactgactggtcataccctccaaaattctgagatttaaaaaatgcttacaataagttatttttctctgttaaatttctcagtcagcattggctttttttatttgtttgtttgttttgagacagagacttgttttgtcacccagcctggagtgcagtggtgtgatctcagctcactgcaacctccacctccctgcttcaagcgattctcctgcctcagactcccaaatagttgggattacaggcacccaacaaaacaccttgctaatttttgtatttttagtagagatggagtttcaccatgttggccaggctggtattgaactcctgatctcaattgatccactctccttgtcctcccatagtgttgggattacaggtgtgagccacgcattttcttctcttgtttctttcaaagtgaaacattacatgcccaccacaggaaattctttaaatgtgaacttcggaaattctaagaagcctgcatctgaaacagttatcatcagttggagttttattaacggccctgcgagactaaacaaaaatctgtgggcctttacagctagttcagagaactgggaatgagatgagttgtggttgctaaaaacataaacttactaccactctatgatattatttttccacactggcttttaataaatacgaagccacaggctgggcgcagtggctcactcctgtaatcccagcactttaggaggcctagtgggcgagtcacctgaagtcaggagttcaagatcagcctggccaatatagcaaaaccctgtctctactaaaaatataaaaaaacaaattagctgggcatggtggcaggcaccagtaatcccagctatttgggagactgaggcaggagaatcgcttgaacctgggaagtgaaggttgcagtgagtggagatcgtgccactgcactccagcctgggcaataagagcaaaactctgcctcaaaataaataaataagaagccacagaaacatggattaaagcaaaatttccacacataaccttagtgaaagttaaaacaaactaggattctaaatagtccccaaagtgtatattaatttacaattaatttattcagaagttttacttgaaaacttttctctagcatttataactcttcttatttatgctgttaagtgtcatggtatatatttaaatcacacttgtttggaataacaagtttgttttcactaaacatttctgatgtattaatatcatctgctttttacctgctatcagtaggaatgttaacagatttcgatatcttgtctcgttaacaccaaacaatgggtgttaagatgttttttaaaaaaattccttgttctcatgattatatataatatatgttatatattatatataatatacttaatttataactattgtatatagtgcataattttcaaagacaaaaacaattgaataagagatagactttcttcttataagttcatcagtttcaaataatcttgcatgtattacccttcctttttattgtcgtgttaataaagcagttttaaatatagctgagcttaaaatcagaatgtgtgacttttctgttagttcatagtaagttaccacaaggcctgggcccttggttaaagggtttgcctgattaggtcaggcttattcaggatgatttccactttgattaattcagagtcagcttgtaagagttcctaattacatctaaaaaattctgccaaattctattcgccagaaataaatcacaagttctgtcaatattcatggtaggatgtgggtggggaacgaggtcatacataggtgtccggtactaaggtgtgacaatcacagatgccatcatagaattctcattactacctaagaacgaattcaacagcagtatttcacccggaacatagtagctctcatttctaacttctctcctgtctgagctacttatggcataatgaaaacaaaaacgaagagctaattgcaaacttatgcatctataaaaattttcatttaaagttaatattgttatgtgtgtatttggtcctgtcattaggatgttagctggttattttgctcgttagttgacgcagttttcttcctagccttgatggtctttacattttggcatgtttttgcagtggctggtactggttgttcctttctatgtttagtgcttccctaaggaggtcttttagggcaggcctggtggtgacaaaatctctcagcatttgtttgtctgtaaagtattttatttctccttcacttatgaagcttagtttggctggatatgaaattctgggttgaaaattattttctttaagaatgttgaatattggcccccactctcttctggcttgtagagtttctaccgagagatccgctgttagtctgatgggtttccctttgcaggtaacccgacctttctctctggctacccttaacattttttccttcatttcaactttggtgaatctgacaattatgtgtcttggagttgctcttctcgaggagtatctctgtggcgttctttgtatttcctgaatctgaatgttggcctgccttgctagattggggaagttcttctggataatatcctgcagagtgttttccaacttgattccattctccgtgtcactttcaggtacaccaatcagatgtagatttggtcttttcacatagtcccatatttcttggaggctttgttcatttctttttattcttttttctctaaacttcccttctcgcttcatttcattcatttcgtcttccatcactgataccctttcttccagttgatcgaaaatttttgcaacctactcatctgacaaagggctaatatctagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactgtccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactaattcaaccattgtggaagtcagtgtggcaattcctcagggatctagaactataaataccatttgacccagccatcccattactggttatatacccaaaggattataaatcatgctgctataaagacacatgcacacgtatgtttattgcggcactattcacaatagcaaagacttggaaccaacccaaatgtccaacaacgatagactggattaagaaaatgtgacacatatacaccatagaatactatgcagccataaaaaatgaagagttcatgtcctttgtagggacatggatgaaactggaaaccatcattctcagcaaactatcgcaaggacaaaaaaccaaacaccgcatgttctcactcataggtggaaattgaacaatgagagcacatgaacacaggaaggggagcatcacactctggggcttgttgtggggtggggggagggtggagggatagcattaggagatacacctaatgctaaatgatgagttaatgggtgcagcacaccagcatggcacatatatacatatgtaacaaacctgcacattgtgcacatgtaccctaaaacttaaagtataataataataaaattaaaaaaaattttcatgtgaacagaagactgagggtcaaaagaattgagaaaataaaataagtttacttgaaaaaaaagttgcaatgaaatctgattgcagaagaattggctgatcaaataaaaacataatgtgtattttaaggaaacaatgcaaaattatcaaggttaccaagtgtacatcagtctaagaatttgtttgatgggtttttatgtttgcttattttaaagaaaaatcaatttgtaagaatttcaaaacagcaaaaatgcttcatgttgtatttatattaaattgacattgattaaatgatgcctacttattccttagaagtctatccatgtaacatgaatactcttattaatgtcttagaaagtttacctgtatcattaaacccctcaactaaacctctttgattcttcttaatttttttactttatgttcagacagttgaattaaccatattttgttatgatacaaaaactcagttcctgtttattgttttaactttgtgctttttctaagttaaatggctctcacattatattgccatcgtcattagcattatctaagttcttctaaactttattgctgtgacaaaaatgaggaagaaatactgctttctaaaatgacattatgacttctttgctgtgaggtctgtgttgtaaatcatcacctctattccccaactgtgaaaggtaaagtccagtctctattgctctcttgagttttaaaacaacataacgtatttggaggagttaaaagaccttgctaaatattggtctgtgttaggaagtgtcaaaacatagacattacatacagaggaaagaagacttcaagggttaagtacattttcaaggtcatgacactacaaaatggcagagttggggcacacatacagaatttcagagtccaaatttttaaccaattttactttttttatatcgcattaagaggaatttatttgtatttccatgtatttacatgttgtacactattcatcttgtaacagcgtcacagtttttcaagtgaaacattttattatatttaaaatttttgtataaatatagctggaattaaaataattacataaaacaatgtttttaatacttttaacatctttcttttagaatagtcttagatggatcttgcacacgtattccaacaatgatgtaattgattaaaaataattgaaactatttattgaatagtcatctttttaatttatcatatgccttttattatcttaagcatgtaagatttccattgtttgatattagatttgaatttttggaaataagcctaacagtcatagaaaacagacttggtagataaaatatacaaccagcctgaataatacatttctttgtttttcctcaaaatgatttcataatcattaatcggcccatggcttactcctttggtaccatggtgtgtaaaatctataacatttctatgaaatcatcctcatctttgggagatttattataaacaatgacaactgaggtaaaaaaaaatgaaatagatatagtcttctcttataatttcaattagcataattctgtttttttttttttttttttttcgagacagagtctctctctgtcgcccaggctggagttcagtggtgcgatctcggctcactgcaagctccgcctcccgggttcacgccattctcctgcctcagcctccctagtcgctaggactacaggcacccgccaccacgcccggctaattttttgtatttttagtagagacaggatttcaccctgttagccaggatggtctcgatctcctgacctcgtgatctgcccacctcggcctccccaagtgctgggattacaggcctgagccaccgcgcccggccaggggatgtcttatttctctgcaaactttacaacgaaactcttaaaaaagacatgttagtactatggttttaatttttcttgtctcatttttaataatttactctgattaggctttcgtctccaactttctacaaaaactattcttgtcaatgccgtacatattaatgcctcctcctcactgagtctcatgcttagtcctcatctttcttgactcaacagtagtacttgacatggccgaactatttgcatccttaaaacacggtcttcacttggcttcagacattacttgatcttgattttccttttacattatggatcatatttcactcttttcccagtgttcttgaactccaattgttgacatgccattcttctcagtgcttgggcctctttatctacattcatggattgcatagtgttttatgcatttaaaaatcacccattcagtgagtattcccaaatttatatctctaatcctgtcttctcctgaaagcctcagacttgtatcccaactgcttatgtggcaatgtagactaataggcatctgagtgataaaaaattttcaaatctactaaggtagtttgaaatcctcttaaataagaactaagcatgacagtcaagctccttgggaaactttacctggaaagtatgttatatatccatacacctgacaaaggtagtagcagcactgggatttgcaacctcttagattactagggcctattaaaacaataataataataataataataaactcctctgtaggataagagttataattattgatctgtatgaataagataatacatggcaacaaacctttatttaaattgatttacaatttaagtttataatgcattaattacaataaaagctgtatttgttcaaaaatattgctaggcataaaaatagataatatttattaacgttagctaagtcaccataggcccttcacatatactgctaacttaaattgaggaaactattagtaagacttctgctttacactcaacgagataatctgcagccctccagaactctgtgctccacatttagataactactcatgaagataattcaacactaggagtcagagaaatctattcttgttcatttttcgctacttaccagttatgtgactttgataaagccacttatccactgtgagctttagattctaaatgcgtaaacagacatcctgttgcgtggtctgccttgcaaggtttttataagatatacataaaattaaacttgaaaacacctaaatgtgagacattatagttatttctgtagacacagtctaattattattgtagacacaggtatattttattcttcagttcctctcttgttagtatttttttttttttttttgtttgagacagaatctcactctgtcgccccgcctggagtgcagtggtgcaatgtcagttcactgcagtctccacctcccaggttcaggtgattcttttgcctcagcctccctagtagctgggattacaggcacctgccaccacgccaggctagtttttgtatttttagtaaagatggggcttcacaatgttggccaggctgatgtcaaattcctggccttaggtgatccacccacctcagcctcccaaagtgctaggattacggaagtgagccactgtgcccggcccctattttgttagtcctttaagggaccatataatcatataatatagtgggcaacctggtctctttctctacagattcaatttctaatcacgaaggaggagaaagaaattgagttgtgtctttgggtatattcttgtgaaatgaaattcagtggagtaaggaggaaaatatgaggcatatcaatggcataaatatttgtattttgagtggtgtagttggccaaaggattggcactagcttcaggtgtgtcctacttggcagtggtacaagtcaacatggttgtatgtgtcagttttgttacatattcaaatgtacagtataacaggagtctcagaggacactgtgatttctaaaaataagtaaggtaaaaatgggtttgtagttttagctgtttgtcctcttttgttccaattgcatacacatcaaatcaaattattcttgtggactgtttttctttatatgttcttcttctgtacccacatagaagaaatcataaactttaacaagatgataatttacatatcaaaaacttgatttaagccatagccagtacataaaaattcatttttgtttagtaggtttatgtctaattagctgaccaacagggggtgtgctaatagtgtcagataactgaagtaaatggtatttaacagcatggggttccaataacacaggagaacacaggagcaaccttctaggctttatttcattcaagtccataaagtcccctgtggtcgcagcagtgcatatttaaaatcagttaatcatgttactcatgggtgttggatatctttcaaaatggcctctggtaatgagctatttgtcctgcattgtgacaataagtctcttccataatttataaagctcatgcagatgatggttagagattccataagaaaataatgcagggatgttctacttcctgcttaattcctacttaaatacagttagatactataagtgcataaatctacatagtccacaatacttttgtgaaatatcatttcattttattatgatgatttttgcttttgtcttgttcaagtagttttaaattttggatgtgttggtgggtataggagtgactaaaagagagaaatgtctattgacccaactggtacttttcatactttttttccattctgtcattgtttgtcttaagtactctacattttgtaagcattgatctcatctttgcacactgtagtgataaggggtatgcatattcttacacatacagcttctcccctgacttaaccaaatatatcaagcaagaaaaacaaccctcttcagctagaagtcttcatcaagaaaacatatatgaagtatacatacgaatacacacacacacacacacacacacacacacacacacacacacgggagtttacaaccatacattacagagttctgcaaactcaaatagcattccattttctggacaattctatctgtagacatcagatgtactcgcaaaccgtacattgttgtttaaagttcttcaataagagattctaggcttttaacctgtgtttataattctaacaatctttgcatttagaatgcaaagtcttgaactctaacctttaagatgctggttttttacctttcagaggtcttctgacagggccctgccattgtacttccccatttcatatccttattgcccattaattaatagcttcaaggtttaaccgaacatagcctgtggataagttcttcttcatgtgggggtgtgggaggtgtgtacttcctgttctcaattccagctacaggaacatcctctctcaaacattgacatgagaacaagacagtgtaagacagtggaatcaataagctaatgaacatcaatacaaagtaaattctttcacctcaatttgaatgtgaagtaagattaatccttattaagaaagaaaatgatgcaaaatggataaatgtgaccattttgttttatcatgttattcaattcatcctaactgagcagttagagattttctagagtttggatggagaagtggatcatggtttcatgtaaaatattgattcacatggttttcagctttactagatcttggcaaacctttcctcctcccttcaaacacacacacgcactttctttaaacattctactttccattttcctttaagctcctaagcatgacaacctgggagcccactgtaaatgacttttctccaggtcgctgcttatggttacaacttctacacagaaaacaattttgccagtatttccctcatctcatcaagcacagcttcctttctgcaaaaacgacagcatccaacgtgcaatgactgaagttattataacatcttgttcaatgtaagcacagctgagttccttagaacatggtttgcctaaaggtcagatgctcaggctcaggttgggagagaaatgatattgaagggacaaaatagcaaacataagaagccacctttgctcatttctgcttcccagcataatttcccaaagcgcttggccctgtgacaacatacagtgctccaaaaaaaaaaaaaaaaaaagaggtcgaaacaaaataaaacataccccactacgtctcttgcatgagtcagtattccttaaaaaataaatgaccctaatcattgcttttttctaacataaaataatgtctgataggattaaaaattatgcctctataatctgtaatcatgaatcatataatctatcagtatcatataatctataagatcatatcttatcatataatctatatgagtgtagcttatagattacatcttatagataagatatactcttgtccctcattaccttaggggaagctctcgttcactggcagattgccatggctaattccagctgccgttcattcaaatgttaatacggatataggattttatttatttatggtagagttgtaggaaaacaaaatgtctctattaacatttctctattttgctaaaatattctgaaattataggctctgataaataatatgttatatcttataggtaagatacactgttacatccaaactttaatataattttacaggtactaaccccccattacctatatgtaaacatcagaatcaaaaattgatcccttgacttaactgaatatttaaacaagaaaaacaatcatctccaggtaaaagtcttcatcaaggaaacaaataagaagtatacacataaaagaatgcaccccgccccccgccacacacaggactatacaaccacacattaaagagttctgcaaactcaaacaccataccattttctgggcagctttatttatttatttatttatttaattttatttatttatttatttatttattttttgagatggagcctcgctcgcttgcccaggctggagtgcagtggcatgatctcggctcactgcaagctccgcctgccgggttcacgccattctcctgcctcagcctcccgagtagctgggagtacaggtgcccgccaccatgcccggctaattttttgtatttttagtagagacggggtttccccgtgttagccaggatggtctcgatctcctgacctcgtgatccaccctcctcagcctcccaaagtgctgggattacaggcgtgagccacctcgcctggcctgggcagcttgatttatgatccgtaggcatcagatatagatataaagtaaaaccctatgtcaaaagagtctgaagaaacacctgtctaaaagattttcctggactgtagactttagtctatagtcctcaagaaaacttctaaataaaacttacttccattctttaaaaacttaattttctttcactcaacgcagacctgtggagactaatgaaagaaagatcaaaggaagatattccagctggattatgaaggttgaggaaagatcgtattaatatgtatagaatttcaataacagcaagctaaagattgttgattagaattcattattctagagagtgttaaccagtttgaagagtggtctttttctaatttcaaaagaatccaacaacttaaagcagtctaaaatgatgattcaactaatcactaaatttaaaataaactgagcttgatatgattttaggttaagaaacagaatctacaaatgagaaagaaagccagtagtttatcctcctcctttgctgggttatgaggctggagtgggaaggaggtcttggattctgtttctataggtgaagaaaatcaggggcttgatacatcgccttactaggatgatgccaacaataaagatttcactgttagtcctaaatcttgtctgcaaagcagctgctgttatcttctctttgctgtggttcatcttaattagaaagactattttatggtaggaggaagtatagtcccatttattttgattatactacatgagaaattctaaaatcagagggttgaccctataatttagagagaataggaattttcagaagtgaatgtgtgagactgggcacaatgccattgtaatgaagcataaggcatagacatgccacttggaaatacatataattttttatgtaatgagtctgggaagttgaggaaaacctctcaaggctttcaaaactttctcttctgtgttcaagaaatagatatgaagacatgaatcaagttactttcattcctaaggcttcagtcatctcatctgtggaaatcaggcacttggcttccacgatctctaaagtctatctaactccactatgctgtcattctaactcttgaaatttttggtaaccacagaacattctaatgaagaaacagcatattgtcccttattaccttaggggaagcccttgttcactgacagattgccatggctgattgccgctgctcttcactccaatgttattatggatatagggctttatttatttatggtagagttgtaggaaaacataacatctctatgaacatttcactattttgctaaaatattctggaattataggctctgataaataatgttaatattaatcttattataatgtaatagcatattttatgagcttaaattcaaaagtatcccaagtgactttgtaaaaggaattctatgtgaatatatgtgtgtgtgtatgtgtgtgtgtgcgtgcgtgcgcatgcatgtgtgggcgtgtgaagttttgcagcagcaatagaagttgtgatgatatctcaaataaattcagtgactttaatattcttcccttttaatccagagtaaagtattgtggtctgactgatctctttgatttataaatctgaaaaaacttctctttgcttaaggggttcaaattaccttagtataaaatgcaaacttcttaacataaaataaagtacacctcagtaccagaattctgttagcctgtgtaagctttaggtccactgtttctctacctgatacaatctgaaatccagccattctgacctactttcgaatgcctgaattttctattttctttccagtgttaagcctttccagtgtctctctcctttgacagaagtacacttcccttgcctccttgcccgcaaactccttttcattcaggtgtcagctagacacatttgactttcagtgagtgggttataatcctttcatgatatcagttctacatctgagcacaaagatagacctaagattttaattgattagttaactaattcatatttaatgagcatctactactactgtgtaaaaacgtcacaaggaaacataaatatgaacaagatataaacccttgtttaaaatagaaatgtggaaaacacagacttattaatagtatagaatatcacatgcgaaatccaagtgctatgaaggtttagaatagagggagttacattttgttgaatttagagagcaatttatgtggatgttaccatattcaaagtttgcaagctgtatttgccctaaagacctttagctctgaaaggtacctctcaggctgctcttgggtgatttggccaaatatcaagtgagcaggtcttggatccccagattccagttcagatggagcagctccactgtattctggggcttaaattttgaaaaccactgtgtttcgactgcaataatggtatattatgacactaatggatattctccaggtgtttttcactatcaagaaaattgatgtataacaaacgtatccccttgaagtggcacttatttccccagtcactgacatgaaacagtgattcatcaattcgtggccttaagtgatactgaggtaactcaagacactatacacttgtcaggtgcattcattttcttctattagtatttatcagaaattacatataacatcgtgatgtttaagaacagcttagtaccctatgttaattgcaaacatgtcaatattttgtagcaggaattctgggttttgaaagcaagagaaaaggacatttcccttaagaacgacaaattcctgaaatacctgtggaagaaaaatgacatcttaactacagtacgactgacccatgaactccacaggtttgaactgtgcagctctacatacatacagcttatttttcgactaaatgccatttggaaatacaatcttctcaggatgcaaaatttgcatattcagagggcatactttttgtaaatgtgtgttttgtagggctgactgctgggcttgagtatgtgcagatttggtcatacctgggggttctgtaaccagtcccccacgtgtaccaagggactgtattttcttcacttgaatatgtgtcatagtacatgatttaaactactttcaatttctgtcttaatcctgttttgaactaaactaagtatgcttctctaggattcaagtgttcactgtatgaggtaaattaactcttccagtgctctagggtagcaattaatgccccagaggaggtaaattgctaaatggtaccccacagctttcggaagactgattctgtgtcgaatggttatgttcctctctggtggagagtagattactcccagtggttctttataggtcaggatccattttcaagtgggaaattagatttcatctgattggcaagctaaagcttctgaggtgtgtcatacaatagtcacgattagcctattgaagacataaatgtcggttatggaagctcaaaaagacagtaaataaatatgaaggcatgaaacaaaatattgggcagtactgcatatttgaagttttgtaagcaagtgagatttgtattttatcatgagctggaattttatatctttacttagaagcatagactattagtggtactccacaaacaccacaaatagtattcattcctctcttcatttattaaaaaatatataaatagatatatagacatgcagaaaacttttactctcgcctcctctttatgcatggttttgtgtgtattgcttgaatactctcactgattttaaaacacagtgctttttctatggatcttactctttggaaattttactttattttgaaataaaaactactttactatatgttatttgctcataatgtacaaatagttttgagtgcctattaagtatgatgcactacacggtgaaaacaaagcctggaatcctgacttcttgagctttacattctaacgagaaaaacgaaaacaaagctacacacataaattattacattgtgaaaagtgcaaggaggaaaacaggtaaggtatgaggtccaaggtagacagcacctggggtcagggaggtgggaagcagccacagatgaagtcgccattgagcacctcattcataagaagacacgcttcatcccgaagagtgtgaaggagcagcctgtgaatggcagagtggggtcaagtgattaagtgcaaaatcccttgaggcaagaaatatgttttcatatctgaggaacttcaaaaatacccatgtgactagaacaagctgggtggtatgagttcagatggagggaaagttggtgtcaggtcatgtaaggccttgtaagctaaaaataaagaagctgaattctattctaagtctagtggaggaagggttttaggtaggggagtgacacaaactgaattatagcaaaaatagcaatgatattaaatattcacacagcactttttttttttttttttttttttgagacggagtctcgctctgttgccagactggagtgcagtggcacgatctcggctcactgtaacccccgcctcccgggttcaagagattctcctgcctcagcctcccaagtagctgggactacaggcgtgtgccaccacgcccagctaatttttgtatttttagtagagatggggtttcaccatgttggccaggatagtgtcgatctcttgacctcatgatccgcctgcctcgacctcccaaagtgctgggattacaggtgtgagccaccgcgcctggcccacataacacctatttataccagagagtagcaatggtattaaatatttacatagcacttataataggccaggcatttttctaaggaatcaacatgtactaattttttctaataatcttatgacatagaactaaagcacagagagattagatgacttccgtaaaattgtggagctaggatgttgctgaaccaggattcaaggctgggcagtcacttacctgtgtggtagctagtgttctatgaatctgtctctatcgtctatctaacttctgtatttccaatctatttacatcaataatttaactgttaaaggttgtgcataagcaccataaaatggcacttgagttcatgggaacagattatatttttcagagaaatcattgttagaacacccaggactgagctctaagtgactctaacagtagagactgggtagaatgatgaaactgtcaaaagaaattaaaattagtaacccagtaataagaggaaactcaggaggaagaggtggcgaggaagaggtggctgacataggggagagtcctaagacaaaatcagaggtcaatgctgcggagagttgaaccaaatgacacgagaatatttgctagattacattgtgggatgtgtccatgaccctgagaagggttttcatgaagtaggaagttgacagacaggatcaagggtggatgagagagaatgctgacttagaacagggaggcagctcttttgaatttggtgttgtgataaaagagaaaaacagctggagaagaatattgggtcgagggagaacagggagccactggggatgccgaagagaaaatgataatgaaaatgttggctatgtagaccttcttgaagggacaaagcaagagagaattcaaagaataaatggaaggttcagcctttgatggaagagggacattctttgatcatcatacaagagaaaaaaagttgcttgcagggttgataaaggatggaaaagggcgaatcatgagtaagatctaataccgtttgtaaggaaccacactctatgctaaatgttttacatatgttatttcaagtaattctttcaaaattttaaatcattattattttttaaatttttaattaacaggcagtggatcttaggctcagaagaattaagtgatttgcccccaactgcaaatccactaattaccagagctgaaaaattaaggcaatcagcctcactccaaagcgtgatcagagagctaaaaatttacttagttattgaccagtcaatttgaagcccggagaactaaggctgacttacagagtatatgcaactcactgctgacagagtttcgtttagaatgcagttctcttcactcctactctagtattcttttcactgtacttatctatttttttcaattgctttagaggcagtatacattttaaagtaaaaatatatgagtattaattataaactttattcactgaaaatgtagtggtaattaagggaggaaactgtaatgattaaaattataagaatcaaatataattggttttcaagagagaaaaaaataagttaaaggactccgtatgactactataaattctcctagtgagaacaccaagtatatacaattagtttaaaaaaagaattttccaagttctttattaacttttaatcagaatgcaaagataattagacacagcctgtttatgtatggaacaatacaatgaaggacagtgttctgctttttggaagacacatacactacaggaacctttgaacatgcaattcagaggaagtttaatccttctgttaacaaatctgattaaaaatagcagtggcaatatttcaaaagttacatgtgtgtgtttgttaaatatttcttcccaatgtaatcgttttttaatcttcaatttttttcttataaatggttgtcaaatttacaagcccttactataaaatcccaggagaacttttaaattccataagaaaactgtatggtttttattcagtcttattatttattgtatactttcactctaattatgtaaatgtggtatcttgcagaatttttgtttgttttctttcttttatccaactgcctccaatgcaccacttcatatgcatgtcttttactctagccattgtgtgttatcataatcatgtctacccagagttcaaatggcttaatacaggtgtcacctcacagcacctctgctcagatcctgcagactttgcctctctctaaggaccctcagcagggcccacaggattgagcccctgttcctcaaaatggtggccaaattaataataaaacttgttttggtttccctttttccttttcattccctcattcttcacacatgctctccaggatggcaaactccaatgaactaagcactaaaacacttatagtaattaaatttctacctggagaagcataaaggacagatacatgtgtctttacttttcatatctaagtgacaaaatgaatcttaccttatcaaaacattcacagacacacacacagacttttatgtcagtgttttacaactacttgtctaggtttgtgattttataaaacaaatgttttagattagttaaaatattagaatttaactcattatgcacaaatgaaaaatgtgaactataatatggcaatgagtcagttgtgttttctttaaattaatcacgtggtcaaatgaaattcacaaaagagcctggggcaaatattttttgatatctgccattagatatgaaaacatgtctattaacttaataagccagaaataaaggggctgcttccactggaagtgaaaatgagagtaagtgtgcaaagtaactgaagttaaaccagtggtactattcctaattgcagtcacactaaatggaagaattcttatggtctacatcaatgctatacattaaaacgtgtattggcaataatagtgtctataataatgggagtatccttatttttacttcaattttcctctcatcatataatttgctgtgtcagactcaggtgaaataaagagggatgtatatatggatatagatagatatgtatagatatatatacacatagatatttgcatactgatggtgatttttgtgcatgaaaaagtgataatgtgttttctactagatttaatcattttctcaaaattctgtgacatagtgagaatttagacctgagagttttttcttaaaataattttttttatccgttagtctagaattttttaaatgccagaattataaattcattttgagtttttgggatgtatttctgataataacatttttctaatcaagtataagttattagagtattaaatactttaataagtatacgttattaaaaaccatttatccggacaaggcacgtcaattgctttgaatctgcagggaagaaaccgtgtgtcacattactcttcagacaacaatcataagaaataaacctacaaacaccaaacttcaaaaaaaaaatcctgcacaaaaagtatttttgaaatcagatgatgggcccaagaagaccaaagggatttaggatatgtggtcaaagttgttctttgatgtgtgtttgtgtattcagcttgtccatccatcaagggctccacctgtcttggagatattgtccatcatttatttatgtgcagagagactaaagtccgaactgatcttcatttcagtcatgcactgaatataagaattgtggaaaacattttggagctaagatacaccctttttttctgaaaagagaagttgtacttcacaggcattttggagtcttccagctcagatttacttttggaaaatgacataaatttcatagataatcccctgatccatctttagacagacctcaacattttgtcaggtcaaattatgaaacagaatcttacataagttttctcaatcatatctttccttgaaagaccatagttaatttcaaaatagacagtatatgaaaatagctgccttgagaaatatcagttaaactccagcattgtatgagaaccaatgaacaaacaacattctcatctctgccaaagttttcaaggagagtgcatgatttcatcctttagccatggtgattcattgttgatgactaatatcatggatgctcacatttatggaaagtactgtattgacacacattgtactacctgctttatacacatcgcctaatttaatcctcataaaaataccatggggtaattattatcaaatatattttaggttaagtaacctactcacttatcttgtaagcggcagagcaaatgcagttatacatttcattctatgcctgcatgattcagaaaaataaaacaaaaacatgtaagcctttggtgtacttatatatcaaaaaccaatttctttaatataagagtttaaaaagctgtacataatactactgtagatgaaacaaagtgtaatggaagacagattgaaaggaaatttgttactattaggatgcttgcaatcaaataatggggataaaacaagcacatacattcctcatctctgtatagacttaacattttacagagtcctttgagagactttaattttattgtatcaaatttttcatgtctaagttatctattcctttcagtctattctgtatgtaactcaattgcctttttgcctttgctaacacagaaatccattaaaatttttaaattaatggacattttaattacatcttcttccttagtactaataaaaatttatatactatgtatatgaatatgcatctagatgactatttcaatatcaatatatgaggagataaaatgaattttccacaaactatgattctgtgtcatctaaacattagcttgcacaggccttttaaagaaagcagagtgaggactccctggccagtgttctctaccatctcttctgcctaccttcttttctctcatggaagtaagaaaagaatccatttcatcaaaggttgaacattccacttcatccctgaattctctcttgctttgagttcttaggtacatctatattagatatcactttctcctctgcatccccaatgcccttttccctcctcagcatacctgatcctctgtccttgctgacctttgtatgtgtgtgttttctcccttgatgacatatccctcttcagctattgctctatttatattcagaatcccaggcaagcaacataaatagatgtctccaaggagtaagtgatttaattagcttgaagtattatatatattttcacacacacagacataaacatatatatgtatgtatgcatataaaacaaataagataaataactggaaaatatatgcaatgaagtcagtgaattagcagatgagataaacatcccagattggtatggtattgtacggtacggtgtggtatggtatggtttggtaccacaaggtctagtgtttagagctggctctgccagtcactatccctttgatactgatcaaatcatacaaaatcagtttcttcatccataataaagccttcccttgttactcagagttgctgttccagtcaaaaataaaatgttaatttatgatacagaccttgataagctgtatgaaccttacatgatactaatgtagtaagatgcaccacggttcattcagataagtgtcccagtgagtcctcagttttcacaaagtcatttcctatccccagttttgtttatttgtgcacctctgcatttacctagaacaagaattgttatattctaagtaattgccaagaagtatggtaacaaattcactactacttgattcttcagtggagaaaattatatacatatatatatatatatagatgcttgcctaaatgatatgccattcttccatacttttaaatactgtaacttgtgttattgaattaagccagccagtcaaaagcttgaaattaaacatagtattttcctatgaaatatattttttaacattataaaataaaatttggaataaaagcattatgtatatatatatatatatatatacatatatatatatactcataactcttcattcatttttgtgaatcagtctcattcgtagttttattgtacttccaaatcttcatttttctttggatcattttcctttgccagcattacgtgtgtgtatgtgtgtgtatgtgtgttttaaaagggccataagaggaaaacagcaagaagtctgtctcctaactttgaaacctaaattttagttttctttcacacaggaagtcatcttgtggatctaataatattatgaagttattctctttttgatggacatttaggaatgttttgatgtttcgtacaataattcaagttgcaagaaataagcacacacattttgcaagtacatctatgggatatgttctaaaaaattaaagtgcattctttgtcccttaacctatgatacgggcattctttattttgatagatgctgcagaattgtcttctaataagtcataggaatttacgttttcagttaaaatgtataacagttcttgttatataaaatgtataacagaaaggacttttgatttctatccatctgaatgatgaaaaatagtaagttatttattaaattattatttaccttcacatatgtatagtggaacactgagcatatgtttaaaagctacttgagtttttaaaatctgtaatctgtgctttactcattttctttattggctgttggttattttttactgatttttgatgcccctatcttgttaagaaaataatatttttataatatatcacatttatcacaagttactgtttatctttgagttttcttattgaattttgacatacacaaatggctcatatttactctttttatcagcagtgtctttgttagttcctggatttgggatatgcttagaaaagtttatcctaaacaaagacttgtgtacttttaatttattgtcatgtttaaatcgttgctaaatctggaatttattctggagtaagaagtgaagtagagttctaactttactttgattttgttttgttcttattgttgtttttcttccagatttgttatctagttgtataaaaaccaatgattaaaaaaaaaaagttttttcttgctgggcaaggtggcttacgactgtaatcccagcactttttgggaggccggggcaggtggatcacttgaggtcaggagttcaagacaagcctggccaataggtgaaaccccatctctactttaaaaaaaaaaaaaaaaaaaaaaaaaaaaattagccggcgtgacagcatgtgcctgtaatcccagctacttgggaggctgatgcaagagattcgtttgtacccagcatgcggaggttgcagtgagccgaaattatgccgctgcactccagcctgggggacagagcgagactccttttcaaaaaagagaaaaaggaaaaaaaaaacatttttccttaatgattttcactgtcaaaattattatttattaattaaatatgtgtgcattttacaagatgtcgagactttgtatcatttgtttgtctattcagacaccagcaccaaactgtgaattaatatagccttaacatatgctgaagcatttggtagaactagtcgccactcattaatctttttttcttttgaatactaaatttttatgtaaattttaatatcagcgtgccttgttccaaaggaaaccacaaaataataaagacaaagacaaatgaaagaactccccattatttgtatggcaaatgtgtgtacttatagaataatttggtgatttatatttgttatgtttataatatggatccttatccaaaacgtgcaaaagcccatttttatatgtaccttaataaagttttaagatttctttgtgatctatcaaatttattgttaatttaaaagcttgatagagctatactataaattgtatttccttaattatgttgcaatagtaaatgttgtttgtatatgatagctaagaatttttaaaattttaattttatattaagcatctaagatgaattattctagaagatgtaataatgatttttttctcctcttcaattttctatatagctaatcataccataattatcattataattttataattctgctccatccattttctggtgtgcatctgctatttcatcttttttgcctatggactacccttgcaaaatgttaaataatggtgataggagcctcaataatgaggcttttgctactttaacaacatacagtgttaaaatataactctcttgttccatgtgtatatttacatatctatccttttaaacttatgtaagttattttgcaatataatatatgccagtattagtttttttttttttttttttttgagatggagtctcgctctgttgcccaggctggagtgcagtggcatgatctccgctcactgcaagctccgcctcccgggttcatgccattctcctgcctcagcctcccgagtagctgggactacaggtacccgccaccgcgccagctaatttttttattttttttgtatttttagtagaaacggggtttcaccatggtctcgatctcctgaccttgtgatccgcccacctcggcctcccaaaggccagtattagttcttttgtgtcatttaaaaatattttgccagctgggcgtggtggctcatggctgtaatcgcagcactgtggtaggccgaggtgggcggattaccctctgaggtcaggagtttgagaccagcctggccaacatggtgaaaccccgtctctactttaaaaaaatgcaaaaattagctgtgcatagtggcacatgcctgtaatccaagctactcgtgaggctgaggcgggagaattgcttgaacctgggatggggaggttgcagtaagccaagatcgcgccactgcactccagcctgggcgacagagtgaaactccatctcaaaaaaaaaaaaagaaaaaattgcatatataaatttttaaaaatatgttatcgttttaattagaggagtcagagagaaataaaggtaattgtaaagaagaccctatatttacaaaataggacaatgaagaggatattagttggggacagaatgagtggaaagaacagatgttaaaatctatcttaattaagaagcacacttaaaggtccatttataacgctctcagtactcatttttaccctggccatatctttatcttgagtaactaatgaagtagaatacgacctatgcagttatgctaaagaagtttcgcgaattcctaatttcttttcagccaatgccatagaatggcttatatgtattataaatggttttcagagtagcagattttctaacacttaaatggacacaaaaagataacaaaccaaaaagagatagacagataaaacacttgaaccatttcatacaaaatttctctgagatttgtctactttttaatttatttgattacctatattaccattcctccatttacatgaacaaataaaagtttattgaaaagttcaccacatgttttaaaagcaactgaaaccaattttaatttctaagaagtaatgttattttcatgttcccaaatgatcacttcaaagaggcgagtaagaggcgagtaagaaggaatataagctctattgttaataaacctagacgtaccctaaatgaagaccaggagtgagtgaaggttggtaatttacttagtagagttgaggaacatctactctaggattctccacaggagttcagctcaaatgatcatttgaaaaatgctaaggatgcgaagagagagaaggcaccaaaaagaaggcaattggaaagcaatggaggtacagaaaaactcttttccctcatgtttgtataagagacaatagaactttgggttctcaccacaaaccttgttcattcagatgactacccatcttccagctgtctatgagacagatcacatattacctgaaaaaatcgtgtgaggagctctggagaaaggcatgtgataataagaagggtgaaactagtagagaaaattaaaacattaagggaaagtcagcatgctgaatggtaagattatccacttcgctgtacttcagaaacatggcagacattgaaaaatccttctcagggcaaatagatccaccttggagaaaagacatttaactgcagacatttggggatcttccacaaacatctaagtaactaactaacgtttacaaccatgaaaccgtgaagtggacacgattctcttcagtatcacagagtctctatttagctatttggtgcctcgccttaagccagaaacaagacttctaagtatctccaggcatttgaggaaaccttcagacatataaggagagacagtaactatacacagaaaaataaaaggaacttaacacatacacacacacacacacacacacacacacttaggcatgaggtcaaagcatcaaaggaagcaaagtgagagaagatttgatgtctttatgaaagcagaattttcttttttaacaaatattagaaatatgttgaaaaaaatggaggcaatctcccataaaatacaccagaaagataaaaggatggagtatatgaagcagtataaactcaaagcgtccaaaatcctagaattaagattcctggaagaataaaggaaaaaataaaatgatggtaaaaaattgccataaatataacagagaaaatattcccaagactgacagacatcagtctccagacataaaacataattgagaaattttatagaattggggtacatacggaagatccacaatggcttccagaaataaaaggtcatatacacgttatctggaattgtatcagaaacaccattctgaaaattcgaagtaactggatgaaatctttcaaaaagttgaagaaaaatagtttttaatcacattcctaaacaggtttgagaatgttttaaaactttcaatcatgtagtttttcaaaatgtgtgtgtatgtactttttctggtccaaggatatatttcatttaaacaggggtgtcaaccaagaaagaggaaggtatatgaaatagttgaagttgttgcctttgggaagcaaaatagacaaaaaagataatggttacagaactagggttggctttgtttttttgtttacgtttttaatcaaatttggcttttaaagttgtatatgtgattatgaaaaaaaaagtggctttaaatgttctaattcaaaagtaagttaattaaaaatatctaaaatcacaaatgataaagagcttccaaatttaaagcatttatgaagtgcacagattttaccagaaattcactcacaaatcttagcaatctcgatagtcatagaaatatttaatgtcttctcactaaatgtgttgtatatccttgctgttaaaagatcagttatccttatacttacataaatatgctacaaaagctaagaaaaacgggatgactagaaagatattcacaagaggccacattatcattaaaaattcactttagctgtgaggaaggatttaaggaaagagcctgttcttagtaggaggcctttgatgtagctgaataagtgtgtaactgatgtgagtggaacctttttaattgacactgacaatgaaagcaaatcttctgggctgctcatcagagtcagaggggatatgggaaattaaatattgtgttctagctttttctaaagcctataaagataatcaaacaagaggcatcttttaaaatctatttgtgagttgatgccattcatacggattaaaataaatagtacttgaatatatgtggttttggtttattttaagcgtcttttcaacaattttatgattttgtaaatggaatttacaactaagtaagtgaatgtgcaactacagaatttgtttaaaatctgatgaagtattatcagatatttacgctgatatgctagtttaaaaattctcatatgctagtttatatatttccctgaagaaaatatattaaagtgtgattcagatattatttcaactgctgatagaaccacaaagaaacacattacatattgcctttgaaagatacactggaaaatttatttttaaaacttcacttgtgttcacaaaaacaaaacttcttaaagcaatgtcatttccctcatttcactgtttcaataaacaatacatttactaactagttcattgcttctctgttaccagactatctctcaacaattatttcaaccattgcttttactttcctggttgaaaagaaatgcttttgctctttctctgcactactgtcaccagtcatattgcaggagtatggactccagccagaataaacctctgtgacatctgcagagacatgcggagaccagagcagactcacccaaacaatcacagataatcttcttccagctaaaaccacacactgagcttcagcaccagtcctgtcagagaagggattagtgggtgccttttgctgtttgcggtgtgaattacattcatctaatatgaggctggattgaatcctagccttatggtcctatgatgaaagaataataaaagattggtggcataaagaatctaacagttcctattctccgaattataattagttattactacagtttatagtttcttatggcaaattttgtgagatttgaggcatgtttaatgaataactctgattgcttttaaaaaggcaaccaaacaatgaaataaatatttttcccatttaagtcagttatttaaacatacttgattttgtagatgtagattcgatttcatcgtgtgacccagtgtacaacactgaatgatattaagcaaggtctcctgatgagaaattcttataatctcctataacttactcttatgtaaattcccttaaactatcccttcatcactgtatgccagatacgtgggaaaatctcccataggttaaaccttcaccttctctttgccttcaccctaacagaaaaaaagtttgctgaagaaagtcacacaaccaggttgactggttttactttaaaatcatgagcgtataactgccaccaaattgacactcagcattgtagggtatcttgctacctctccccagtaagatagggttcccactcttttagttggctgcttgccttatgtttcagtaaaaacaaaactataagagcgagccaccataatctctccacaacctaatttagaagtttgctagtacacatatctatagtctttgctttttacctctggatacaatggggaaaaaaattgtagcttctttttttaagtttaattgcacttcttgtgctccgaattccttactctcttagagtcttacagatttaatctattcgttacctttgttctttttcttcactgctcatctctcttctaaataatcattctcttcagaatatacagaatacaacatgctataatatttctcatcgaaagcaaacacataaataaaaaaagaaatgttaaaaaaaactttacaccataagggttttcagtttccctcattttttggctttctacctatcaaaacttcttgtaagagttttctatattggctatttttattttctgttatttcatctgcatgtattgttattgttttttccagtttatattttaatcaagaaataattcccagactttggtatatttctcatgccccatgacttatctgaacacattgttacggtataaatgcatgtgtctcatccaaatctctattgttgtaaccaaagacccaatttgataatattaagaggtagggactttagggagtgattatgtcatgaaggctccatctgccctcatgaatagtattaaaatcctaattttagggctcaagagaactagctaagcccttttgcccttctgccttttccaccatgtcaggatatagcattagtcccctctggaggccactgcattcaaagcatcatcttagaaccagagactgggttctccccagacattaaacctgcaggttccttgatcttggccttctcagcctccagaaatgtgagaaaataaatttccattcttatataaaatatacagcctccggtattttgttttagcagcacaaatggtctcatacacacattggcaatgtaatgaaactcagaaaaactctaggctctccactgagtctaagttccatttcattttggcttcctcacttcagctgcttttattgatgtcaccagttgccaaattcaacacagagcaatgtgctctcttttgtactttgaattatacaatactgtggaggattttcgcctataaaagtttttccatcttagcccaagtgttccacatgcttctcgttttctcccattcttgcttacttgttctcctcaaggtccttttctgttttctgccgtctacctgctgagtgtctaggtttaggctcctttcaatttctatttgctctcttactttaagtaccacctatatactgatgactattaagaatatatctctgaccctgatggctcccttaatcttttgggtcatatatccaactgcatgcttggcagttctactggattgtctaatgagaatctgaaacatactatgtccaaggagtaactctagacccctcccagtcactaccggccactctctacagccacttgatcaactttttatcttgccaacttctctgtctcagtaaacattatctctgtctacccagttgctcaaattaaaagcctggaataagagtctttatctttaatgatatatactaatatatttagagtaaacttatatgatgtctaagatttgccttgtaataattagggcaggggctataaaagaaacattcatcatgagttattaattgttgaagttggattatgagtaatataacatgcaaattctgattcaataggcccaacgtggggcctgagatgctgcacttcaaacaagctttgtgctttcagtacctcctacctcatccacaattcttatgttactatgctacttattttcttaatgggaatttcataatacttatctgcacttacttatctgttatccttgttaattttctgcctttctccctataagggcatgcattgtatatgtcttacttatcgccacatcagaccagctcagtgcttggagagtaggtgctttataaatatttataacaatgttatggagggcaatacaggaaataataacaggtgaacaataggtgtagatgttagtgcagtgccatgaaactgaattttgtaatcttggttgtgagattacaaatgatatttgagtttcactctcaaaattctggattaattggcttgaaatgttgccttttgcagagcttcccaggttaattctaatgtgccagcaaagttaagaaccactgccttagatcatgacgatgatgatgatgatggtgatgatgatgatgatgatgacaatgacgacaacaaacctaccatccactttgctctttgcttggagctatttcaagtactttatgtgcattaccttatattattcttataagaatcctatgaagtagatactgctatggttatgttagaactgaggaaattgagatgtagaaatggtatataatttccttaagatcaaccaatttatacatcatgaagccagcatttaaccactatttaaaccaaggcaatccgagtccatacccttagccattgacttaagatgatggcatacatgttacaagcactgggaaacaaaattgtgtgtatttttatttctaacatatcactcatctaaacaatgtgaaacacaatactcaaatatggcaaatgaaggagtaaactttcttgttttccctaaaatgacgactttgggactacttatacatttgctgaagcaaagtaatcattttaggtcccaaagctatcattttagagaaatcaagaaagcagagagacagagataaaaatacaaggaccatcatgaattatcaataactcaagaattactgtgcttggtttgaacaactagagcaacagacatgagccctgctcttcgcagagattgttctggtcttctctggctctcctttgcctgcatcccacaaggcacagtgtgtgtggggcctaggagacttgcctatcttgagcctgtgcctctacacacctcttttaaaccaatgctcttagtacccagaaccttgggattttctgcagaatgggtgcctctttcctgggtatgttttctcagtgaagagtaaaggtaattgtttgagaggagggtgaaattgtaatttggaccaattaactggggactaatttgtgtgtgtgtttcagaggcttatttggcatatgtatttgagggatgttatcagggaggaaattggggtacagactttggacatctacttgcattctcaccctaaaggtgcatctgcggtcaaattccaattccagagataaggtcaaggagttaatcttaagaaagtaaagggtaaatcttgaactgaagatgagactctagaaatactctgttatcttaggtatttgaccaatggcaacttcttccctattccattctcagactccttgaggaatttggcaataggtaacgctactcatgttaagttgctataagatagaaatggggcttccattgttcactcttcctgtgttaggagaaccaatattgcagtttgtcatcttgtggacattacattctcaccaaagaagcctcctttgcctcctccaactctgtttgacctagagattgacaaaggaatctgcttaggatcacttgggattcttctttctataggcatgtgggacgataatttgggtcacgtcctgagattttaaataaatttcaaaagtgcaatgaggagtcagctttgtaaaagaaaaaaaaagacacttccataacagaatttttttgtagctttcaaatttagctaagcatttgtttcctactgaataatcaacacttacagagcctgaagttataaatgtaagctgttttaaaattatgtacagactttctgcaattattttttctagaacaagaaagtgtattctctttccttttcaggtaacttaaaaagagctgaatatgttgaacttaatgtgctttatgagaatgctgacttcttaaatgaaaataaaaaatattaattttctgcttaggaaatgttgagaacaatcagtctcataatgattttgcattttaactgagcatatccctgtatactgcaaaaaatacactcaaattgcccatagctaccatgaaaggtaatgatgcagtacacttaattactgtttagcagtgcttttttatttgagtattttgaaatattagtaaaagcgttatatctcatatttttatgaaggacttcaataaaaatgtggtaatggagatcggttaaataagaatttcaaaactagaagtgattttttttctctaaaagtaactgatgtcgtctttttagaaaagagaagaacaaaattaccatggaaagcatttctggttttgtctcttcattattcttggcacaattaccaaagatgttttgaagatcttggccatcatagtaactgatcttatctttaaccatcataaaaaatttctggtgtattaaatgtaccaaaatattttaaaatattttttcagttatttgttttgcatttcccattactctacctatgtataccatgttgagaaacagggacaaattattctttgtttgtatcatttcttactgtatttacacataagtacatatgttactaacttcaaagaaaaaaaatatttcttgcttcttatgcacgttctttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctgcacgttcttatatactcacctcccacaatgactctgggcttgaccatgtttctttggcccatgagatatcagcgaacatgtcacaagcagagactcaatgcactttggcacattgggacatgcttttttaatcattgacctgagattgctacataggaaatatcaaatctattaggcttttgttcacaaatttgagaacaaatctataaggatcttattgaagaattgccatagtagagttacaatattaatcaaaaatatattaacttcttttttaaattggatgagaccatgtatcctagagaaagactactaactttagaattctgtctcctctttccagatatgagaccttggggaggtcatttaaactctttgtgcctgcttcttcatttgtaaaatggtgataataacagtacctaccttgtaaggtttttatggggaactaaatgagttaatattttacagtgcttaaaatattatagggggtacataaatataatagttgtcaaataaacagagaaggattagacatcggggttttatgaggacaagctctttgtaaaagttcaaagacctatatcagttacatagagagtaaagtaccagaaagaagagctaaagataagggcttataagattcattttattttgggaagaaatctcagggacagaagtaaaggactagagagacaaagaaggagggaaacacaaatacaatcgtatttttttactgctggtccgctgggcttgatcttgcctagggctctgtagactgcgacttagaaccatttgtcccagggaaaatcagaaggcagcgtttatccatgagctctcatccttccctgattaaggtttgcccccatatgataataacttctttggaacttgaatgttgttaataaaggagttgtggttgagtttcttcaggttgctgttttggtagcattaaagaaagcctattgaaaatatcaagatatttttctggaaagcttgagcaaggtattgtcaggttaaacctgttggaaacttatgacaaagtaatgcatgaaataaagggtagactgaaagaatatgaggcaagaactaagaagatgcaatgggggaacaagtagatgtcacctagacttccagacgtttgcatcttaacattgcagaagcaggtgcaatcgaacagaaaaacaagaaagaatagtgcatagaaaaaggaagatggtaacctacttgaagagatgaaaggaataaaataattttcatgataggcaggaagaagagtaattggggaaagcattgatttgctgaatgttttcctgtgctatttcatttttatctaatttttgatagagaagtttgcttgaaaacaaggtaatttctgaggttttctgaaaactatgtcaatgttcattaggctacaccaaacttactattaataaaattgcataattactttataaagtacatataattacttttcaggtagctccatctagcaatttaacaaataaaatagataagtaacatttaaaaattttgacaccaacctgaccatggagatgcatagaattctgtaaataggataattcacttaataagccagaggtgataatccaatctccatatcaggatctgcttaaacaaataaagttagcagtcctcattagtgctgtgaactgtacttagatgcttttagaacggtgctgccatgagttatgactaaccgagaaaaatgtattctatagccaaatgaaatcagaaaaattatttttaaaaaatatcaaaccatagatgaagaatttgaaacgactacataaaacctttgaaaattaactcccaatgtaacctatgagattatttttagttaaaaaatatgattttccccttcactgataattttctccaaaaatctctttcaaccttttgaaataccattatagctgtaaagccttctggcatagctggcattttcattgaactcattgattaatttagtatcatggaaacaatgtgaatctgtgtgaaatagctacagattgtgagagaagttggtgtactttattctgaaatgtaaaaataatatgctgcacaagcatgctgattttaaggaagccatcagtatcatagactgattaattctgtgttgctttgactgctaaaatgtgctcttccaatcaatttcaatccaattaataaaaattataaactggatttgaatatctatttaacattaggtcttccatgcagtttcacatactgtatatcacttcacaagcagtatggcatactggaaaggtcctcaaaatgggagtcaggtagctggtttttaacggcatttctgatgaaaatgatctggtggaaaatttgggatacctttctgcatttacgtattatttatttcataaaaaattcagctacatgattttaaataccccatacattctaaattgtaggatataatttaatatagattcactttttggtgtgacctaggtgaatctgatctttcaaattactagtttcaaactttacacttacacatttcccactgctaattggtaggaaattaacttggtatatttcttatttcttctgttttattagttttgtttttataattttgatttcctttgataaattctgaccatagacattttgagtaaaggcacaatatatcatttggacaatagtcttgttttcatttggatgttaactatcactatgaaagtggagatgccttttttggaagagttatcatatctagagtcagtatctctggcttttttatgtgttagcctcagcaaggtttttgatagcataataagtatcaatgaattaggttaattttttcatagagaatggaaaaatcttaccctcaacctgtttgttagctgtaatgtaaaagagtgtcactgattcgatattgagctttggctcatgctcagatggcttagacagatgggccatacaagactctgggcatccaaagtctcctgcggagaaaggaacaaaaaagaaatttctgaaattcactgagcatcttagaaaatacccaaagaaatatatcagaaagtaaaagtaaaataatgcaaaatgtggtacataaagtgaattgtgtgctcctcttcccagaaaaattagcaaagttaatgccattctaaacccaatcatattgttagaactttcgttgtacagaaattatttctgcttattgacatatgaagatcagtggagcacaagactcctagcttgaaacatttgatcaagcagtgaagatatccagcatatcataaaatgagaatcataaaaccatgctgaaggagtttgtgagtttagccttttctgagtcatcaaagacaaatacttattaatagaattgtatgttataatttattatatgaaatttcagattttattttgagctaccatatcctctgtaagtattaaatttattagtagttaaatatttgaaaataaaccaaaaggtatttgttctccatgtctttttgaatcaagtatcattgtgtaatcttatgtagagaaagagtactttgtaattgatcagtttattaataagcacaatgtttcttacaagagacagccaagactaatggttaaaaaaaaatgtacatacacacatactcctcagtgaagaaacagaattgggtttaaagttgggactatgccttttgtcttctgaaaggccttttgactccttgactgtgttagtcttttttcgatgtaattattacttcccctaccataatgtcatcacacttcagtagtttatttgcctgattgagcataataataattgagggcggtaaatgggatgatctggttcactattttatcatcagtgtttggagcaagccagaaacatagttggtcttcagtatatttggtgaatgaataagtccttatttgtatagtcactagactatacattgtcaatcaaagtggcgcagcatatacatgttaagctgaactcaacttttcactgatccaatttgtgctgcacccttccattgtatgaaatcaccatattccatttttttttctaccactaggtttccttccagctctaacatttcttaattctactgatataaattattcataactcctattgcttgtaatcttgttgctcttccagggctagaaaagtcctaaagggcttgcctagggattaaagttaattccctacagtattcccacctgtacagagccatggcatgggtagtgctgccccaggggaataatcttgggtttatcttggttttaaaactggtaactgaaaaaacaaaacaaaacaaaatgcaaagaatacccacacatcccaatcaagtgacatatatgaatgtttgtttataattcagctaagaatagttaattcacgtcatgcctcatgattaagtgcaaaccatttcaaaatatgaaacaaaacaaaagataatttaaagtccagccaagtaatctctcttgtacttgaatttggatgagatttatttgatcttctcacctaaattccatttataattagggatactcttgcttttctgctgtctcctcactggagaaccaaatggctggagattgactgattactgatcccttggggtttcagagaagctgctttctcataatatcagagttgaaatagttttcattccgttgcaaagatatatgttttaaaatgcttacagtaatgggttgttaactctatccttccctggatgaggtttctatagtaagctgtcattgtattacaactgttttaaaggatagataaagtaaaccaccttctaggtagtaaatggcaaacaatgtgtttccattattgaatttttattttcataagcatatcacatacaagtagtttaaaatcagatagtactaaaacaggcttataatgaaaaatagcagattactggcctcattccctgctggccttatccccaacaggacaacttgctgtcctgctccctgggtcaatagctttcactttcttagctgtttcttctggtgtttactcttatattcataaataaaatatatttactagtatttctgaataagtatattttatacatgtatttattttctatcctccaacacccaaactcccatgctcatccctcctcccctccatttgtcccattatagaatatatcaaaagtttgaattaaagcaatgttcaatgctcacattattttgggtacatagctactgtttaaaattaaatcacttggaatactgtaacttcacattatgttttatgttttatttgtatttgtattaatttatttttttgaaacagagtctagctctgtcgcccaggctggaggacagtggcatgatcttggctcactgaaacctctgcctcctgggctcaagtgattctcctacctcagcctcccgagtagctgggattacaggcgcctgccaccatgcctggctaattttggtgtttcagtagagacggggtttcaccatgttggagactggtcttgaactcctgatctcacgttatccacccaccttggcctcccaaagtgttgggattacaggcgtgagccaccgtgcctggtccacattctgtttcatataacttgttattgtctttattgtaaataattgcctcattttcatattggctatattttctctgtatcattagttcttttccaaaaattttagcagtatcatataatgcttcagagaatgatataattcatgaaatctgtaatctagcatgttatttcctctttgaaatagtgtgcccctcaaataccttgacattttcctttaaggttgtggtttgagatagagggaagactggactcaagttcttgtttgctttcaagaactcaccaagtgaagggagaatgcccctaaaatagagaagccaaagacactctcacccaaaacaaaccccaaatcacagtccccacccctaccctataaaaagcactcccaagtcaagcctcgtttaggaaaacagaatttgaggaaaacatctttgaagctgtaatttaccagcccttgatctttgaggaagatgagaagtgaataatgcccatgtgtttttcttactttccaagtgaggtctggggcttttgggctttaacttttctggatttaacttccagagcacctgcactggaggtcatagttagagcagaaactattcaacccaaaaccaccagagagaacaagagcagacattcaagatccttgtcagctgcctcctgccccaggtgactcacagaaacaagcttagaacagcctactccccttcagccctagaggtgtctcagtttatgtattcattattccctttcatttgtttcttctctacttcttccggatgggtagaccttggaagaggatgccagtcttcctagtactttctcattttggtaggacaaatggtcagtttcatgaagtaatatgtttactcttgctttcttatttcataaagagatgattccttgagacttagctcatgtgttcaaaaatagactggttgtgcccaaaccctactgcatagtagatgggacttaatatttccatcaggctgtgcaccttcttttccaccttgttctttggcatctatgtttctggctgttttattcctcattttggtggagaaatgaggcctcaacctcctgggctgaggcaggagcctccaccagcttcctaagaaagggtgcacccaggagacaaaattctgagacttgtatgtcaaagaattcctttagtttacctttcctctcgataaatctagacatttagggaaaaataatttttcttcaggatgctaaaggtatttattttacagttttctgtcatcttatttttaagatgacctattctgagttctgatttttttatatcatgtgtgtgcatgagtgtgtgtgtgtgtgtgtgtattctttatttgaattttctaaaagcttttggtatcttctcttgatatgttttagtttctttttattttttttttaatttttaacatttattttatattttttcttctcgggaatgcttttggccgggcatgaggtctcacgttggtaatcctcgcactttgagacgctgaggcaggaggatcccttgagcccaggagtttgagaccagcctgggcaacatggcaaaaccctgtttctacaaaaagaaatgcaaaaaattagctaggcatggtggtgcatgcctgtagttccagctacaagggagtatgaggtgggaggatcacctgagcccgggaggttgaggctgcagcgagccatgactgtgccactgtactccagcctgggtgacagagtgagattctatctttaaaaaaataatatttgtgggtatatagtaggtgtatatatttatggggtacatgagatattttgatgcaggggtacatgagatattttgatgcaggcatgcaatgtggataagcacatcatggggaatgggggatccatcccctcaggcatttatcctttgagttacaaacaacccaatcacactctgtaagttatttaaaaatgtacatttaggctattattgagtatagtcaccctattgtgctatcaaatagtaggtcttattcattcttcctattatttttttgtacctgttaaccatctctaactcctcaccagccccccactacccttttcagcatctggtaaccttccttctactctctatgtccatgggttcaattgttttgatttttagatctcacaaataagcaagaatgtgtgatgtttgtctttctgtgcctggcttgattgtagatcttgctgtggctcctttcaatctgttgtcagaagaagatgcagagacaagcatctagagaggaaagaaaagtcacatagcatacaggggatcctgacttcagaagaactggctttccaaacaaattaatagcacaagtgttgaaaggccaaaacaaaacaaaaaaactataaaatttctaagtttactcatcctatctgtggtgaaataacagtgtctttgtcacgtgattattatattcgcaaaaggcttgacttattttcagacatcaatatagcaaaaatcaggcacaacattatttttattatggagcaaattgtaggaaatagtcacacacacacacacacacacacacacacacaattttattccctatataaacctaaagaggactgtcctaaagaggacatctgtgttttagttttgcttcaaaactgaaaactgatgttcttaagttctggaaaattttattaatttttcttcttcttatctctaccattgtcttaattctttttgtaattcctagaattactttttcctactatcttttctatccttttttctgtctttgtctttttgttattctttctggaaattttcctcaaattttgtccaattcatatcaacttttatttttaattttaaattgtatagcttttattttaaaataagagctttttcttgtttgttttctttccctcctttttctatagcagctgttctatttttatacatgtaacatttttatcatccctgcattgtcttttctctgagccatatttctttttttcttttttcttttcttttttctttttttttttttttgagacagagtcttactctgtcactcaggctggagtgcagtggcaagatctcagctcactgcaagctctgccttccgggttctagcagttcttcctgcctcagtttgccgagtagctgggattacaggtccccactaccacgcccagctaaatttgtatttttagtagagacaggattccaccatgttggccaggctgatctcaaactcctgacctcaggtgatcctcccaccttggcctcccaaagtgctacgattacagatgtgagccatagagcccagccccgtatttctttagttttggtctctgcctttcatattgtattctggtctcaccctaaacttgcctaataatttttagtaattaaaaagtaatattttacttttagtaaatattccaaaagtaattgtgcaatattactttgttaatatttttaaatttacttctagtaattaaaaaagtaaatattttgctcttcgtaaatatgtaaatacaaaagtaaatattactttgtaaatatttgtaaatttacttttagtaattaaaaaagtaaatattttacttttagtaaatacacaaatagtacaaggcattagaaactaggtgccacattaactgggtgatcaaacttagtatcaccactaatggaacatatggacatgatggactgtaggatgagacccattgacgactgcaaagtgtcacaacataaaccgaatctaatcaggaggaaaaaatcagacaagttcagattgtggccaattctacaaagcaacctgcttaaactcttcaagtatgtcactcatgaaattaaaatatatgtatatatatacacactatatatatatattctttcatgtaataaaatacatatattttcatgaaataaaaatatatatttttttcatgaaataaaaatatatatattttttcatgaaataaatatatatataagtctagattgtggcaaattctacaaagcgactcacttaaactcttcaagtgtgctattcatgaaataaactaatatatattattatattattatacatattataatacgtattttagctgggtgtggtggctcgcgcctgtaatcccagcactttgggaggccgaggtgggcggatcaaggggtcaagagattgagaccatcctggccaacatggtgaaaccccatctctactaaaaatacaaaaattagccggacacggtggcacgtgcctgtagtcccagctactcaggaggctgaggcaggagaattgcttgaacctggcaggcagagattacagtgagccgagatcgcgccactgcactccagcctggcaacatagtgagactctgtctaaaaaatatatatattattatatatcgtaaatatatattatattatatatttagtatatatatttattatatattttatatatataaaataggctggggatgttttatagttaaaaggacatgacaagtaaatgtgatgcctgcttcttgattgatcctgggacgaagtggctgagaagcatgatctggggtgagtaaccaataaacaaagcagcctactgtgattctgttggaagaaagccttgctttttgtgctggagcatcgtcagcacttagatgatgtgagcttttctacaacccaaccatctgctttttatctttcaaaacatctctcctcatatcttacatactatagcctcccctgtgtgttttttgtgggtttatattattcttattatagttttatgagattgccagagggagaaataatttatgttcagtatgtcttattaaatggaagtcaaatatatttttaaggatgtaacttcttttctacagccccaactttgatcttatacattaagcataaatctaagctaattctaatttctagtcaaaggttcaaatgactatcaattcacttcaacaaaatacatacctgtggtatttggttttctgttcccgcattagtttgctacagatcatggcttccagctccatctatttccctgcaaagaacacggtttttgttgttgttgttgttgttgttgttggctaaatgattagaacccatggacacatacaggagaacaacacacactgggactttttggaggatagagggtagaaggaagagaggatcagaaaaaataatgaacgtgtactaggcttaatacctgggtaatgaaacaagctgtacaacaaaaccccatgaaacaagtttacataacaaacctgcacttgtacccccgaacttaaaataaaagttaaagaaaaaagaaattcataccaatttaattgcttttaataaattttggtgagtagtattaagaaatcatatgtatttacatgataatggttaaatgcttgtgtgcaggtatgttagaataacctagaatttagtactttggttaaggtccaccttggagattggtgtatgccttaagcttcaatttcccaacttttaaatgtcattaataataattataaatatttcatggtatttttgagaaataatacatgccaatgacttatgacattaataaattttatgatttctgtaatattatcttcataatgatcaatgatgtaatatcattgagaagtatcagaaagtagagatgtttcacaaacaaataaaaaatcaaacaaaacccaaaattggaatgtgcattataatgatgtaaaggataaagaaggatgaatcaaaattaattacaaataatcctctaaacgtttgaccaaatcagaattcatatttctccttcagataaaatttctctttttcggttgaaagcacagagaaagaaagtggaaatttcagatgttggagaaaatattcggaatttatgtgacactggataatactaaatgctcattctggtaactgcaaccttctttcaatattcctctttcctagtaaaaccctaagcatcacacaagaatatattttttcttctgcttttctccctgattttggaacagtttcttaacattcccacaaaaacatggtttgaggtaacgacactatcgactgaagaaggaatgagtttgggaagcgttgagatgtgggaaagactaattgtgccttcatataaagactcttagaaaatgacctcaggctagtatttccaatcatcttcaaatcttccgttgaaagaaagtgactgctgagtaatcatttgcactcagagttttgcaaaatatttgagatttagttaaagaaaaggggaaagaagaatccagtgctactgacaactgtggtacccagaccaatgacagcaaatgagtctgtgggatcatcttcacagcctccgaatgacagagcatcaatgaaatgaagaaaatagtgctttttgcgcttctattatcttctaactgataacgtgcatacattgttagtatttttccacagaatggtttatgtcaaatacttaggctaacagcatctgtactgagaagactctactcaggtgcttagaaatttttctactgaagtgtttttccagtgacaaagttctttcatattcttcccacctggaaacataatggcatattcacagttttcaccctgaaagtgtattaggtatgacataatagatgcctcattccagctaagagttgctaaataaataaatccacctggcagtgacatttatactagtttcgggaaatttttctttggcagtagagaccttgataatgcaacttaatgtggccatgatggtgtcttgcattgtgaggttaataggaccaatcagtggggatgaattatggttcacctttacaccattttatccctgctttgctgatatagacctgaaacagcctatctaattcctttgggaattctctaatggagcctccctaactcaagttactataggatgggtagatcctccactggagctgaaagcctcctgttgggtcctcatttgtttagtttgttatctctcgatacttgcttaattctctggaatgtcttcatagatgtggctggcaggcaatgccatttaatcattttttttttcctggttagccttatagaaaatgtttctttttttctggatggtgaatacataaaaatttattaaatataatcatttaaagatagggtaatttaaaagaggcataagcttaagcatatctgcatgtagcctccatattttgttcaaagatgtgtgtacattcagtgtaacataaatttaatatttgttgactaagaagcaaaaatatattgttaacaggtattctatgacacagttggccagtcagcaactagttttcttcagatcttttcaaaggctgcttgttgtcgctttatccaaaggagttgatagatgtgtatgaagcattctggctgacccatggcaatttgtgtttggaagaatgagatttagagccagggttagtacaccatgtggattgccatgggcattatttaggtgtagataagcttatctgaaattgcatctggattacctgactaatccaaaaaaggaaagaaaagtagagacctgctatggaaatagtcatgaaacaaaggagcgctaggggagaggtgggtaactaaatgctagtttttaaataatgttatatcagacttaaaagatacatggaagataagacaggcctaagagtttgctagcagctggatcagattgcaaggaagaatctcagtctatcctttattactcaagccagagcacaagactagtttccacattttataaatatagagtcttttttggagactgtgaaatttggatagaatgttttatttctcattactgtttacagattcgttatgaccttggcctgtatacactttcatgacaggttaagtgaacagaggttaaaggaggcaaactgagagtatttaaataaagtttacttgctatatttgtcttatctccccatgaataataaaaatatcatttattatatgtattacaaaatgttctaagtgctttatacacctaatattagtatggttatttcacacaaattttatgatgtctgatttctttttctttttatagatttggaggtacaagtacagttttgtttcatgcatatattgcataatggtgaagtgtgggcttttagtataaccattcccagaacagcgtacattgtacccactgggtaatttctcatctctcaccccctcccacctgtttgcatctccagtgtctatttttccactctcgatgatcatgtgtacacattattttgctaccactcataagtgagagcatgtggtatttgactttatatttttgagctagttcacctcaataatgatctccagttccatctgtgttgccacaaaagacattatttctttctttcttatggccgagtaatatttcatgatctatatacatatataccacattttctttatcgcatcatccactgatggacacataggtggattccatatctttgccattgtgaatagtgctgcggtaaacatatgagtgcaggtatcttttatagaaacttttatcacctctatttaacagctaaggaatctgaggctcagagctagtaagtggtgggtgtgggattcaaacccagggagtccaatgccagagtcttaactacttcaccagaagcagagggaaggggagccattttattattcttgatttcaaataagcggtagtttacagttagtactgcgtacacattacatgctcaacacataatagtgctaaatagttttttttgttgcatccctattcaggatgggggtaggtgagccctcctctcccagtattcctcatccttagaaataggcactaaatagttccagatcacagtttaaaactattgctatgggaaatgaattgaacaaatcatgtgcttaccttcagcactaatattctaaatcaccttagattaatgccagtaaataccaagacagttaaaaagtgcattcgatgtaaataactacaatgacaagttcacaaatagcaacacaactaggaattccacgtaggagcagaatataaagtaaaatgaaatgatgatctagatagacagatgatagatagatagatagatagatagatagatagatagatagatagaggagagagagagagagagagagagagagagattagatggacaggtatgtagtttcacctataagcaaaggcaaaaatgagtatctcagaaaggcagatttagggaccactaagattttaagttgcatcattctgtaaattggagattatcacttactgtactgtcacaaatttcagataagttaacattcccgaatgttcttggcacagcataaatgctcaatatcttcaattatcatactttttccccttcatccctgccctgacacatgatagatcatttcttaaaatatactacagcatgtattaaataatatttctactgctcagttttctggggaaaatagtgtttagttaatttctaggttttgttaagaatttacaaaatatatttcataaatgtgttcttttcctttcagaaataaatgtataattttactcacaacatttcaacaactttcctaacttgcatacttcatttttctagtgtttcataaaagttctaaatttaatcatatgatattttaaaataagatattaagcaagaaaacacagcatctattgtatttttaaacgaatcttatggtttttattttattatttcaattactgttactaaattattaattctaggttagaattataaagcattatcaaagatacagtagattgcaattagagtttacttgatttggcaattattaaaaaatgaacatttttttctgtgtcaacaatgaagtcagttaaaatgttttgtggaactaatatgctgatagcaatgctgcagaattaaaagtcgcattattattacacaaacattttgctaaagtttggaaattattcctttattggggttctgttagttttggagaatatttatatacatatatatatgtgtatatatatgtatataaatatcctgcaaaatgtagacctttcctcttagatcagtactagcatgctaaatattttattttttaaatatatattaggtaactgaaacaaagaaaaaaggtttttatttgcttagagagataacaataatacttaacttgtaaaatattcctttgatacattcataaataagaagataaattttctaattcttatctgagaagcatagcaatttactttttagaagcttatacattatggcatcctttgattaatgcagtacattttttctcacaatttataatggacttccaataatcttgcctttaaactgtatttgacctcccttattttactttccaactagaatgaagagatgggctactagttgtagttcactgtagaggctttatgctatctgaaaattttagacccagtggctttaataacattgtaaactgattctgggtccattttctcttgattgacatgtctacttccacatataatggtaaatgccttgacttttctgctccttgtgagtagattggtttgcagatttacataaatacatttcccggagaccacatttaccacatttgctcatgacagcaatgatccttggtcatttcacatgctgtagttacatgccattcaggaggctattgttgattgcctgtcatttctcctgcctagatgtcattcaaagggttatttgttattttaatttataggaatttgtacattaagttcaattaacctaacagggccacacaatgagtcaggttcaaatgaaagctgcagatattacttgtgaaagttaccatggaagatgatgaggaaggagtttttatgactgacctgtggagttagacttatttgtttttccaatgatctctactccttatgtttccaatagtttaagtgattttgaaatgaagtttttcataatatctggaaatacccacccctccaaatttatacccataccagtttacaatactttagacatgacagtatataagtaggaataatccattgttatacaagccccaaaagagaaagaacaaaatttgagggcagattggaatagttaagatattttatgtagaactatgtcaatattaattttgtataccaaaatttgacaggcttttatttatttatttatttttgacatggtcttgctctgttgtacaggctggagtgcagtggtgtgatcttgcttcactgcagcctcaaattcttgggctcaagcgattctcccacctcagcctccccggtagctgggacttcaggcacacgccaccacacctgactaatttttgcattttttgtggagagcgtttcaccatgttgcccaggatggtcttgaactcctgggctcaagtgatccgcctgccttagccttccaaagtgcagagtgcagggactataggtgtgagcacctatacccggccccaaacttttttttttttttttttttttagcatatcagtgtattagttcgttctcccactgctaatttgtaaaggaaagaagtttaattgactcacacttccacagggctaggaaggaatcagggaacttataatcatggtggaaagggaaacaagcatgtccttcttcacgtggtggcaagaagaagaatgagagcagagcgaagggggaagccccttataaaaccatcagatctcatgagaacttactatcatgcgaatagcgtggaggaaatccctgattacctcccactgggtccctcccacaacatgtggagattatgggtactacaattcaatatgagattcgggtggggacatagccaaacaacatcaaccggaatcttgtattgcaagtttttattgaattttaaatcatgaagctaaacacttctttgataaacatctagaaggtgagaagtagctcaactctggagtaaggctaaactgggtctgaatatgttttatattctctggactttgaaatatgtctcttgataataaactagttaggtctctctgtgaaaagtcaaccctgcttactctaaaaatatatatatatttatttggcctgtaaaagtttaaggcccaccagggcagggagaggctggaaatcaatatttttcttatgaatttaaaattttagaaaacctatttcttttttaaaatacttaatatttaataaaaaatatatggatttttattttcaatcctgtcataataacctatgtaggtagaattgccttgaactttctctttcctctgttaaatataaatgtttttactcatttgtttgctgagttattttttataacagaatacattttctttttcctttctttaagaacgttttgacaaataaacatatatatttgtggtatacaacattgtgttttaatatgtttacattgtagaatggataaataaagctaattgtcatatgcattacctcacataatttttggggggtaatgagaacactttcttagcaattttcaaatacacattttattaactataattaccatgatatacaatcaatctcttgaacttattcccattgtctaactgaaattttgtatctgttgagtaacatctcccccaaaccttgtcccttccctccagtctctggtatgcagcattctactttctaattctgttagtttgacacttttatgactccatttatacatgagatcatgctgtatttgtctttctgtgccggacttatttcacctaacatgatgatctccagcttcatcgatgtatttgcagatgacataatttacttctttttaagtctgaagattattccactgtgtatatataccacattttctccatctgtttatttgttgatggacacttaggttaattctaaaagttgcctgttttaaatatgctgatgaacatgggggtgcagatatagcttcaacatactgatgtcagtttctttgactatatacccagaagtgtgattgctgtaccatatggtagttctatttttaattttttatgactccatattgtttactgtaaaggctgtagtaatttatattcctattaacagtgtacagggctccccaccgcccttgccacattcttgcaactcttgttttcctcttaattttattatttctacttcagtttccttaactaagaagagaaataaatttgcttgttgcttattttgggatgatcccacaattattatactaattctgttagtataataattataacacttatggtgtctttctgggaaaactgaactaggtggttaactgcagttctgggaaagtctagaagaaaaagtccagttttggtaagagaaccctcttgcctttttaccttccctgggctaggtatggttcctgaggcaaacctccctccctccctccatccctgcctcctaccatagcgaaccaacaatttcctcagtctgaactgttccatcatgctatgagtgactcttaactattcatggaaacttctagaagtaaaatcccgaatttgtgcaatgagttaactggagaaagctattctagtaaaaaaaaaaaatatgaaaaaaaggaggctgggagacagcaaaacttctttgaattaccattttcttccctggtaggtattgttctcgactttgtttctgctatagtaaaatatatccaggtggagtaactagacaggcatgaggacttgatggaaaagaaagcatggatagtcatcacattcaagttgttttagttatctcttataagcaaaataattgagaagtaaggctgtcacataactagacagtgaaagttagtgagagaaggaacaggctgtgatctttggaaaggagatttctatttttgcagaactgctgagaatagtgagtaaaagtctgcataagacatactgagtgaaagtttggggttgttttctttaggcccatgacataactagctttgaatgataagttaacaatgtgaacatcatgtgtgcatagaatcagctttttaactattagttgttgattgtgctctgggaaaccttagtgggacactgaaaaatgagttaatgttaaataaggagttgcagaggctgacagccttggaacctttgggcacaggcatctgaataactttgcaggaatgacctgataattcttggattaataaggaaattctccctttacagaagatgacgtgcagattattaaaaactgagaatcttttttggaacctgtggcaaacccaaactcacccaatctatgtcataattttagtgacttggtattgtttgattgtaatgactaacaagcaaaccagaaagtcttccagaacacatttaagaagttacgaaaagggctatagatgaagaacaaaacagcactatttaaatttcattgcacacctaggactacaaaaaatactactttgtagttttcttgagtctatataactttcctaatgttttctatacattctccctgccgctcagctaacagctagaaatcactttgtagaataaaagggctgaggattgtatttatttccaagacagtagggcctacagaggctaaaaatcagcatctcatttttcagtcgatatggccagagactaggcaagtaacggagctggtggcagagaaaaaaataaaaaataaaaaataagtagattagggagaaatggaaaagaacaaaggcagctagggcaggtcaatgaacttgacagagaggaggcttctatgttccctcattttttccccggcataatattttgtgatttgacatttatttgataccccatcaatctgttccttggaacacttgtactgtagttgattttgtagagtagcacatgcttatttttcacatatataaattgtgtgttcaaagagtatctttatggtttactttctgattaataggctctgaggatattttgcttatcctggtgaataatttacatctgcctcgtgtgttttgcattttcctttggcttcattttcattccatgaaattttgcaagatgcgttctctcctttaagtggatgtgaatttctactcagtgaaaagcaatctagacaaaacagtgtaatttattagctatttttcttacaaatctcctacaacaaaactttattttatcactgccaagtaacatctccagtctgttttatgcaaaagaaatttcatatcctgattggtcacagtgtaaagttggtatttaagaaatatatttctcatatttatagctataatgtaaaaagcataaaatgtaaaatttgaaaatgtgttttattttcaactaagggcatgaaataaatataacttttataagtattatatgtagagatgaattttcctcagaagttgaaggtcttccataagtatgttcatatataatgatcttttatacaatttacattgcgcaactgtaccacttatattcttaatagatgagtgtgcgttcatttcatgctgttaatatctgcaataaaccttcaaattaccaactattttattgatactgtgttttgtagagcaccatcaacgtgtgaattcttaacctgtgcttcagctgttttctatgtatttgagctaaagtactatctacactttgcatgtcaatttttaagtctatatttttctcaatacaaaagagatcagagacaatctctcctgcttggttcagggaccagaaacacagtaggttctatccagagtcatcaatagccattgttctttttattgttctaaaataaaatgtaaaaccataaggatagcttaatcatgctacagacgaacttatgttacaaaagaaattatttacagtaacactctaattatatctacctgccaaaaaggaagtaagcaaataattataacacaaagtgataagtctttaagtacagtatactgtgagatattggaattgtttttgcagaatttgaaaaagttccttagatataactaggtttctatttattagcctatataaacacaaaaataagagaaataaatgtaagtggtaaaataattagacttggtgactacatcaaaaagttttacttaaaactttggcagatttaataataaatttcagtgaagtttttatagatatgaatcttccggttgaatttttgactttgaataacttaatcaaatgcggctctggattgcataattatagtttacacttgcataattgcatttttatacttttgccttatttgaagtattaaagtaattatttattatttgttacactatacattgaaattaatgacctagtcacacactcacttatatatatttgtatgtcttatggaagttattcatacaaaatgttgagattttaatgaattctaattgatactcaaacttgtcatattcactctatatgcatttcataatttttggtaagggtgtggctatagaggttagccaattcacatcaatttttaattatatactttttcaaaaactataatcttctcagtgttactaattatgaaattcataaaataatatccatgaaatgacttgggtgataatccagtaattatcaatagtcacttgctatcatattcggatgacataattataacttagactaacaaagtttgggtcatttgatgaatgggtggcttccttttattttattacaattatgagacttgttaataatgtatagaatttgtataatattaggtttaaatttcttttctgctgcgattttgttcgtttgtaataaaactatgaaacacactatttgagataatgtgaattcgccatttttatttttgatcagtttctaattaatacatttacttttggggggaaaagttgatcaataatgagctgaaatattgcctttagccctaataaagtatattttggaaaacaaatgttaccttaaaatgacaataacaacaacagcaacacaaaccttcacataataagagcccaaatgagatagtttaaatctagcttaagctctacttaataaacaacaataatgtataacactattggacaaaacaaaatattaaaaacctctccaaacataggtctagaacagagactagcactgtcttcactgggatagtcatgaatttccagtttcggtgtactgagattcagtcagaacttggacttaaaaaacaaagacactttgggaggccgaggcgggcggatcacgaggtcaggagatcgagaccatcccggctaaaacggcgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaacaaagaacttggcctcttggttttagtgacttggaaataagaagatgaaaagatgaatattcactgaagaactctttctttctcactcttttctgcatcagtgttttacaagtagttgtggagtgagttatgctgaagcagatggggacgcagagaagccagtagcagatgggcacatccaggttaccctgcatggttgggccgcaaaccatggcctggggtggaatggagaaatctgtacacatccttttcacttgtgcgttttagcaggtgcagcatccgcagcaacatccttaatgctttctccccagttcaagcttagtttctcccttagactactgtaataacttcctaactgatttctccatctcatttttttcctcctccaatccaatttcaaattatcagtcagggtgatcattttgaagtgcaaatcaacttgccacaataagttatccattggtctgagaataaaaaccattctggagtaactacaaaggcctgcaggatctggaacctgaacgcctgtggagcctcatctttactgctcagccatcccttccttgcccctcccttctcctttgcatcactccagcccacttgccatgcttcttccctcctcgtccttctgctggagttggccttgggcttcaaagcctcccaaacttctctacttagctaatttttattcatccttcacatgtcaactcaaacttcatttcctttgagcagtcttcccctccgttccacattagttccggtcttctactgtagcgttcaggatgccctgtacattatcatatttgtaatgacatatttatcaatgattaggtgatatgtctttctaagtacagagttactggcctctgagcacagggcttggcacatgatcaaattttagccagcagagacttccctcaagatatttggaattggaagtaaaaaggaaatatatttcccatctggtgcacgaagctgacaaggataaatgcaaagttggagataagagaagtggagatgctctaatgagccttgttgttgtccctgaagctacctgcagccctgtcctgatggtaatttgggttgtaagtcaataagcatcctactttcatttttaagtttgttgacttgggtctctctcactggcaaggataacaaccctgactgaaagaatccttacattatgaaactgtaagttccataagggctagaatcttgcctgctttgctcagcaacgttgatacctaacaaaagtttgttaaatgaatgcatgttatgcaataataaattcattttaagttttctggtagatatagcctgtcatcacactttcatttgatgtgatctgaaaataaatttttctgagatatataagggccattgaatttaaagataactaatattacacgtaggtattatttctctctgaatttctagaattatacgtacagagagaacatgattaagaaaacaaatacgtaacaggtaagacaaattaaactggctagtgaattttttgatactcggaaaaatcagatttttagtttgtgtttgaagcaaatattcagaattatcaggacaggtttctacaaggattttaatctgattccttcaccaaaatcattttaacatttagctataagatatacaaatcatatttacacctactgtgttaaaaaaaagtttaacctttttaggacagaatggggccagtacaatcagacttatgtaagaaatcctcaaataaccttcttttgtcacgatgacaactgggagcaaataatatttaaagcatgagtgagtagttggaggagtatttgacagtttctgtgaggaaccattgactgaaaacagtgatcaacccactagatattttaaagtaaatttaaatgagcaaatcacaattcctgtcactgagaatgacagcactaattgtcaaagtgaggaccagaggttcagagctaagtggatgtttagttatatgctaatagaaaaatgcttcctaattaagatatgcttgaaagttctctctctgtctttcatctctatagcctatatttaaatctcctgactcttcataaatatgcagtggtgaccttaggacagggcactgtttagcaaatatcttttaaaatcagaatccacaaattctattttttaacaaaatgttgtattgcatcgtcctccttaggttttaaaaacatacatgcacatttaatgataaaccaatgattttaaaaggcatgtgaactgcttctcttcagacatggttgaggatttttgaacatgatgcaatatatttctttctaggacagttacagaactggacttttctttcttcctggtgtggtttattaaaacaataaatcaaagcacgtagaataaggagctgagatcttgagaggctgacatgcagaaaagctgagatattggcaaggcttaatcgttgaagcacccagtcaaagactcagtcagaagaggaggtggaggagaacagccaggaggacaaaggggtttcaggcttgggctgaacctggcatcacacagaggggactacacctcctcctctggggactaccttgagtcaacctcgcagaaccttttgtatcagagtaaggtatctgaaaaaccagagcagctgctctaatggttcagggctatcatccttagatctgaagggtcatggctacacatgcatagaatatggaaagcagccaggtgaaggcatcttccacaggctctcatcattctagtgtgtgtttttcaatgcatcatttatgtcagaagtgtttgaaaaaagctgttacaaagttagtccttattttcatagatcactttctaagtaaacatggtctaaattataggatgagagttttgatcaatagcatgcctgtattgggtgctaaaatagtgccttgggtacttgacggcagaggacatcagtaatgtgaagaaggctatagaaagaagcaacagtagacacagaataaaactgtgcttttctaattttgtctaaggttttcgttacaaagagtcaggacaacatgaataactttattatttccaggaataccaaaataattggtatttatacttaatttctagttgttttgtgtcttgtggaaaaagcatgatcagttaaatatggtgaagtaattaaaaatatggagataagtatagtgagaatcatcattacataatttggtaggtggtgtcatgctgttactactgtggttccatattgagcaaacattcaagtctcatgaaatgtacgattttaccaactcaaaatataaatatcttaagactggacacattaaattcactgttatagtgtattactgtttataatgtgagttacaatcttgtgcaatcattttggtgtgccacggctacgcaagctttgattgaggagagaactgtagagaaaaccaacatagacaacctcttccaggaaacttctgggatagtcatcaacgcagaaacttcatttgcctcctaatcatctactgccatttccccagaagctcagaaatgtgtgacttcacatggtcaatgaacattgaatatacagttgactcttgaacaacctggctatgaactgcacggttcactgtaatgtggatcttcttctacgtctgccaccactgagacagcaagaccaagccctcctctttccactcctgcccagtctacttaatgtgaagatgacaaggatgaagacctttatgatgatccactttcacttaatgaatataaaatatttttttcttattttcttaataatattttctttgttttagcttatgttattgtaataatgcagtacctcatacttataaaataaaaaaatgttaacagactattatcaacaaggcttctgaccaacagtaggctattagtagttaagttttgggagagtcaaaagttacattcagattttcaactgtatggggagtcagaaccacaatccccattttgttcaaaggtcaaccgtatctggaaaaaagtcacacaaatcttctaaaatagatgaataaaaagttgaaccatattaattgcttcaagcaaaattaaccattaaaaataagcaattcattgcactttatagagactattaacagaatactttaataaaaataggactttttttccttgagttaaggatgatttagtaaaataaactggttgcaaaaaatgtacacaacaagcagcacttatacattctttagcacagaagggactgcctcagagacctctttaaattcttaaggcaaatttaaaatcttggcaatttcctcgaaggtgaacaactaatagtcctttgtagggacatggatgaagctggaaaccatcattctcagcaaactgtcgccaaggacaaaaaaccaaacactgcatgttctcactcataggtggcaattgaacaatgagaacacttggatacaggaaggggaacatcacacaccagggcctgtcatggggtggggggaggggggagggatagcattaggagatatacctaatgtaaatgacgagttaatgggtgcagcacaccaacatggcacatgaatacatatgtaacaaacctgcacgttgtgcacatgtaccctagaacttcaagtataataaaaaataaatattaggtaaaaactacttaataagcatggaagcatctatgtagatatttgaaataatacacagatattaaaaaaaaaagaatcaagaaaagagagggtccttgcactcatgtgggcctggaatcaaatccacaccgaattcacatgccttcattggtcactttagcttcagaacccagccttctcatctggagaatagacacaatgatgactatatatataataatctcatctaatccttgcaacgatcctacaacttagaatatggtaggtgtttaatttatttttgtattttactctatattttcttacccatgataaataaattatgttgtgcatcacaactctacttggggaatgtaaataaattccatgaagtcattcaagacgtcattttaattttgagtcagtgtttcttctccagaaaaatcaatacagtattaaatatctaaaggtataagtcattttgcgaggctaataagatgacaccttttataatttatgatttaaaaaccattgcttaaaacaaatcacttgaaatcacctaaaaactagccaatcgcttaaaaagaaaacaaattttaaatagagttttagtagcaattaagtaattttttagttttaaagatacattagaaatgtttattagttggaaatgtttatccatatagcacaggatgaataagtgattacataattcaagaagtaaagcagaaaacattcaaccaattagaatttttgaacatcttgtcctttaaatatcagatatgtcaatatgataaataaatgatatctaaaacatctatcacaaaaactgggtcatgatgagaatatttatatgttaaatttgttagcttttctaattttctcaccttcccaagggtaaaatcatgcttatattcaagattaatcactgcatcctcctccccaaaggctttctacccttccactaagattttttattcctaatacaaagccaaaaacctttacaaaaaccactcttcgaaaaccacctgggtcagggtgatagagaagaaatagtaatgcaccagaaattacagttccaaattctttacatccttgacatttaccacttcaaggtctcagtagtatgaaagcagggcagtggggtggatgcaatgactttcaaggtccttctgacttggtctttctgtgtgtcgcctgtgctctgtaatgattacttagaacaccccttaagtgagaaagttggggctggacagaacctaacaatcaaggacctggtatatttgcagtaaagtatctattccaactcctctcactgttctctcttgtctctactctggactttcccgtatttattttgatgctaatattcggagtgatgttgatgtctcatcacgaatgccattccctagagcaagcttgggcaaatgactgcctgtgagctaaattctttcaaccttttatttttgtaaataaagttttattggaacccagccatacccaattgtgtacccttgtctctggctgctttcatgctacatgggaaaaactgagtagttatgacagaacctctatggccacaaagtttaaaatatttactatcttgctatttacagaaaatatttgctgacttctgccctacagaaacataagcaaacagcagtaatcactaatatcaattaaatggatattattggaactcttaaggggcactttatctatagatatcatttttttgacttttattttaaattcagggggagacgtgcaggcttgttatataggtaaacttgtgtcatgggagtttgttgtacagactatttcatcacctaggtattaagcctggtaacagttatttttcctgatcctgtctttccttctaccctctaccctctgatagacttgagtgtgtgttggacccttctatgtgcccatgtattctcataagatactaatttttatctttgtgaaattttgtttccttgaccaacatctccccaatccctccactccccagctccaaaaaaccaccattctagcctctgcttctctgagttcaactttttccgattccatagataagtgagatagtgtggtgtttgtctttctgtgcctggcttacttcacacaacataatgtccttcaggtttatccacgtgtttgcaaatgacaggatttccttcttttaaggctgaagactattccatggtataaataccaaattctctttctccattcatctgctgaaagacacttagggtgattctatatctaggctattgtgaaaaatgcaatgaacctggaaataagttcaagacatttattatacatcacagtgactatagttaataacaatatactatatacttgaaaactgtgaatagagtagatttttttttttttttttgagatggagtcttgctccgttgcccaggctgcagtgcagaggcacgatcttggctcactacaacttctgcctcccgggttcaagcgattctcctgcttcagcctcctgagtagctgggattacaggcatgcagccaccactcctgactaatttttgtgtttttagtagagacggggtttcaccatgttggtcaggttggtctcgaactcctgaccttgtgatctgccagcctcggcctcccaaagagctgggattacaggtgagagcccctgtgcccggctaatagagtagattttaaatgttctcaccacaagaaaatatggtaagaaggtgaggtaatgttaattaacatttgttaattaacttgatgtagccattccacagtctacacatatatcaaaacatcatattgtacgccataaatatgtataattttatcaggcatttaaaaattattaatttttattaaaacggttataatagttccaaccgtgttgtgtgtagattcacaaccattagaagttacaaattgccacatataaagggtggtataatataaagtcagttttaaagagattggcatggcattttgtactgtatttgaaacatgatcaacattgttatttttattttattttattttatttatttacttatttatttatttatttattttatttgagatagagtctctctctgttgcccaggatggagtgcaatggcatgatctcagctcactacaacatccgcctccctggttcaagtgattctcctgcctcaacctcccgagtagctgggattagaggcatgcattaccacaccctgctactctattttgagtagggatgaggtttcaccatgttgatcaggctggtcttgatctcttgacctccagtgatccactcaccttggcctcccaaagtgctgggattacaggagtgagccaccgcgcccggccaacattgttattttgaaatgtttgtatgagaatagaacaaagcagccaccttccccctggagccctgcaggtcggctcctgttaaccaggagccagggacgtggccaaacaagtaacaaagtcactacacgcttcacagccgcaatgctcttatctgtaaatcagacaaaatgcttgtgtataaatgtctgcaaagatgtttccaataaaagaaagatttggtttgtggatgtgctttgttattcttcttattaatttggggctagagacaagagaagagtctcagggaaagaaattccttgtttgaattaatttagtcaaatcaggtcagagaatccagaacaagacttagctgatgtttcttcagggcacatatgtgactgcctttccactgtgaataatatctactcaggccatgtattcattctaccacttgtgagatttatgtagcattcttgcctccatagtgctaaagatgcctggtagggaagtttaaagttactgcagcaatttcttttcggtgcatattaaagttgtggtgccttatctatgaggcggagctgtaagtcgctgtgatatcttgcttcgaattaattcactagttacattcaacggacatagaagtagagtttggcagtttagaaagctggcaaattttctgtggctcctcaaacattactgtaaaatttgaaagctttaatatgaagggtttcagtttagtcacagagtaaacctaaaatcctgggatgactgcttcccttttatctgtgcctcatgaaaatggatacatttttttatacctcatcagatagacttttaaattccaatcgtatgaaaatgaagacccccctcagttagagtagaccacaaaatgtggctgattgtcggtgaatcaggctattacagttacacaaactgcgttgcagagcaaaaaacaaaacaattgttactgtaagtaatgaaaaagcagcaaaatgcagccacataatggtaaagacatgagacttctctagtattttaaatgaaaaagcacttgactagctgagcttggtgcttaacacatgagaaagatgcaggaaagaaaatgatcaaaaggcatggtccagcctcatgagagaagagggtctgcatgtcgtgagggccactttctcaatcctgtttggatcttatttcacggcttcaggttggaccttccacttgcaacttgctgtggaggtgctcttctgcaagtcccaagatcccaaaaaggaaatacaggagtttcggtgtttttgagcaaaacaaagtaaaaagctgagtaaggaaacactatacatagctggaaataggttattttctatttgcagacaaagaacaatataaacaaagctcgagatcatctgggcaggttgaaaatagcttcagtctcaaaacagttacacatctgatctgatttcatcacattttaatttttcttcctctgcctcatcttcctcgttctccttttcttccttttacttgttcttcttcttccttatctctctcttcctgtttctctctttctcctgctcctccttctcatacttttctgcatttgtactgcatgtgagatttcaactactcaaatgaattacactcataattttcccgagtggggcagagagaagggggactttcaaaataagcctttaaaaggaaagcactttttacctatatttttcttttcttttttttcttttttaaaagttgagcttataagatcatgcctggtgaagctgtgttcatccactcctctcagcattagtggaagaattagagtattaacgaccttatagaccaggtattttgtagcctcctttacagtttgtcaagttgttaaaaattgatacaagaaaacttaattatttcttcagagaaaagctggacatgtgaactatgttaaccataaaacttgcctgtcttatgtttctataaacagccaggtttgaagcacaagggcaaacctatgcatctatgtgtatatacacacgtttctattttatatgcatatatttacatgcatgtatagtttttgtaaatttattcgtgattcttagtggttatcaactaaatatgaagcagtgttctagctgcttaaagagttggaagaaaagggtggtgtcaactctgcgattttgctgatcaaatcgagattacagatacatgttttgcttagcccacataggattgttttaaattacattttgctgtgtttctgcttttagaagttgagaagtgccccatgagtatccagagcttgtagcttctcttgagaaatctgaaggtcttgcaagactagacctgctgccttccccagcagcagccgtcatctggaaggtgatagttgctaataccctgagtcaggggagactatttctccatagtcctggcagctgcctactgtgttatccctgagcttcactcatttgttttctggcctgatcctattgttatttcgagttcctactcctatagatctataaggggtgactgaaggggtttggaaaaagactaggttgggggtcagttgtggggtattgtggcaaaaatgctgggtttggaagtaggtggtctctctgatgagcttgcttatgcctggtatgcacccatgatgttttccacaacaaaaactagaaaacacttgccaagtatctgggagtggaataacaggcttgagagaaaggtccccttttggcatagaggcgtgcatttaaaagcctttattctgctgctaaatactatttgaaagagaataaaataagtacagtctcttttggggggaatagggtggaaaaaaaggagtgttatttgcaaatatttcaaagtattctataatgactaatacttgtaaaaagtaacttaggaagccttggcagcgaagggcagaatgccatcggttaatattccaagttttgtgtgcctagtgaagcaagttagcttgtaacagtgcttcaactggaaaaatcacaattgacagcttcaattcataaggagcaaagcaccacagtccatgaagaaagtaactgccatggtgagcactctgcatcagggagaaacacacacacacataccacaccacacacacatacacacacacatacacacaatgatcaccttcctggaggaagaagagtagtgaattttaaaatgaatactttttatttgtgtttttctgttattgccaactttaaaatgtactcgttttgattaagctaggttgtgttacaatattaggaattaatttcaaacacattgtgtttttacttcaaaataatttacttcaaaaaaatctttatgtgtatttacaaaaatagtacagctagtaaaatgacactgtattggcttttattgccaaaagaaaaattaagtgtaatgcttaatgaactctttgaaaattttaactgttagcataatgcaactcattctgatttccattagatgtatctattatatttgacccacatagtttaagaaacctgtaattaagacactccacttttgaatcataggaaaatctctacatcttatcttccttataagtttaaaaaaatttaaaaaaaatttgcaaccaatcaaagtcatgctattccttattttaatgccagttttcctggtattttcgataaatttaaaaaattacaagtgatatttatatatgtaaaatgagggaaaattctacaactataaaatcaaattgttttcatttcttaggaagtcaatataaatggtctttcagttgataacaatgtctgttcattcacatcaataaataatttcataattccaaggctctctttatccaattgtattttaaagagtacacattttgtgatagtttataaattaaaggatatatattcaaagtcacataaaaaatatttgagttaattacaaagtaatcatggaagaatattccttacatttctatttattattgcatgaaaatggataatttcataactttttatatataagattccaactggcctttatttcattacatataaaatgaaaaaagatgagttgatctgacagcacagcccaagttttcaaaatttgttaatgttattgtattgtcaacactaaatgttaaatatatatacacacatatatatacatatatacctatatatatacctatatatataatataaaatgctaagaatataaatgttaaggacgtacatccacattttgacctgctccatttccgacctgggtcagtttgcctctcgtttgcaaccacattacacacagctcctgagaggtcaccacattgatgccaaatagtgcagacatgtgatcagcatggcacattataaccaggagctcccaggcccaagcaatccttctctcagcctcctgagtagctgcaactagaggggcttgccaccacacctggcacatgcacattttatttctaatttaattttttaaaaatatgcagcttattatctaaagaaagacctttctaacccttccatttaaagccataaaatcatacagaggcaaaaggacttcttggagctctgtggttttcctctggtggctaattgtggttaactctgcttatcagagttcttttatctggaaatgactatctttctagtgcatttcaagtatcatctactttaagttctgatcacatttcatttaccacttatatttggtgtgaatgcaaagatgaatcaattacccaatttcgccatctttttaaaatgcatagcatctatgcactaaaaatacaatacaataatgtgcaactcaaaaaattccccaagcaagaagactgatgatttcttaaatattatgtgaccttctatcgcctgattttagaaattctaagtgaggacaacttggattgtatcctaaaatattatgctgtggactcactctccatgtatacaataggtttgacatttgatagaaattaggggacagcagaagagaaagaattcttaactatgtctgtacatagttaactaccctaaggcactttaattcttgtccatcctttattctagtaaaactgtcactgaaccaaaagatatatctgtataaagagctctgtactgtcaaaagtaaagctacttggcaaagcttatgagactttatgtcagttttctacttgaattatagttatttcactaactagttatctttttcacatctattgtgactagagaatgagatgtagcagcaatctttgttgcatgccatttgtaaactaaatttatgtcatagatttgcatgctaagtacctctctggtaagaagagctctcaaaggcagcatgtttatgccactatttgtgattaaattggaattctaaagcagacccaagttaaacatgaagacaactttagatcttggtctgaagtcaaatatagactgtttacttaccattggagttatcttcttcttcttctttttttgtggctattagcaagataatctgtgatagtttttaatcatctctcttttactaacttcatagttttaaaattttctgtgtttttggtgttggcataaaaggtatgtgttcaaaattcatgattggctaaaataataagatctggagtttgaaagtagtttcaacaggtgatttagtatataaaattatatatacttacatatactatgtagttattaattaggtaccaggctattgtcatcacataaatcataaacatcttcaccagaaagttttcacttattcattcatttaacatatatatgttgagtgtgtatgaggcaccaaatgccacactaggctgtcaggtgccatggtttaccagatacactgttcttgaagtgcttaccttccagttgggggatataaaaaaggcacaaacaagagaatgagttagagaaacagaccatgtgaaatcacacaaacacatggacagctggattgaccatttggtcccatttttcactgtcatttaacttcttagtcttcctcatctgtgaaagagaagaagaagatgtgacttacctgttttaaatggtgatgaaactcatcacagttttcagctaggggccaaagccctgagttctgtgtgcgtgaatggtctcagcctggagttctctctagttgctctgacttgcataactctgtttcactcggccacaaattaagtgtcagggcacatcccagcacctacttgacctcccttaaataaccccagtgaggatctctaagataatttttaaattatgaaattaaatgattaatatttttaaatagaaaaggtagaaaaatgaataaaagatgaaatctctctgtacttcttttgcaaagtttccccagagggaattactatcaactgttggctttacctttttctatatattttctaaatagtttttaaaagagaaaatacaaagttctgcaactttttggctggttaattttcttaaattggtacataatgcgtatttattttctcattattaactactcaaatactctaaaatatatacagggaaatccttctttggtacattctttctctcacctgtaaccccaggaaaccaatgttatataaaatactatcatatcctctgcaaaatattgttatgatttgaattgtgtcctcctgaaagaagttgaagtacaaagtctttacaaatgatcaatttgagatgaggtcattagggttaatcctaatgacacagaggctgacatgcacagaaggaagacgaagtgaagacagggacaagatggccatctacaagccaagcaaggcctataactaccagacattagaagagaggcatagaaatattctccttcactgtagtcaaaggaaccagccttgttgacgccttaattttgcacttctagccttttgtatttgtccattttcacactgctgataaagtcatacctgagattggggtatgcctttatttttctataaagaaaatgatttttttataaagaaaaagaggttcggtggactcagggttccacatggctaggaaggcctcacaatcatggtagaaggtgaaagtcacatcttacatgccagcaaacaagagctaatgaaagctaaacaaaaggagaaacctcttataaatccatcagatcttctaagacttattaactaccatgagaacagtatgggggaaactgccctcatcattcaattatctcccaccaggtccctcccacaacacttgggaattatgggagctacaatttcaagatgagatttgggtggggacacagccaaaccatatcacctttggaatgtaggacaataaatttttcttgtgtaagccacccagtttgtggtacttctttatggaagcctgagggaactaacaaagatttcatacctatgtggattggccattttaattccaattattatcagagaacaataaaagtgaccagaaatatcttctttttatattctttaattaaaaaaattcaatagtaaatgggcaagagttgaatagacatttttcaaaagaagacctacaaatggcaaagatatgaaaaggtgcttaacaacattcttcatcagaaaaatgcaaatcaaaattaaaaacaggtatcatctcacccctgttaatacggcttctatccaaaagacacaaatattgcagtgtttacattcctgccaccaggttgcccacagttattttgaacactgaacttctttgaaagatgactgaagtctacatattttatgcccctaactactatggtatctctggaaatctgaatgtaaacattgtcatggtattgtcaaaacattagatggatttaagaaaataatatagagaactttttataccctgtatacagataaggcctgcaaaagtctttccatataaaaaaaggaaatactttattgacagaactgttttccctttgggccaccctctaggaagagaagaaacggagctctgttgaataactttttcagagattcctgtagcccagaggcatctgagaaatatttgtagacatggagaaaaggaaaatgaagcagttgtcagtactttactccatgtgctgattttaacttacacaggtaactttgaattggttaaaaaacccaggcaatttgactagagctcatctattggaatctcaccttcaagcttgagagtcttgaataaacttattctttgacttaaaatgacctgatttctttttgcaagggtttctgttaatgaacaaagtctctgtctcccccgtcactgcctgatctaaaatatcttattccttgagtcttgcccatatttaccagatcattggagacaggtgcaatagtgaattcgcatttttaacatttttcaatctaagttttaagattctattattgagatgaaaatatttctaataagttttctggcaatattaatgtgtgggcaataaactaggtatggcagtacacctgcaagaagacagttagatatggtctttgttgtccactgtctcaccccaaactaaagtcttctctacaacagtccttgtaggtgggtgtctatttttccattaaatgtttgtattgatagagagatgctaaagctgtctgattcattttactgaggcttgaaaagtatgtaatgtattcatgatattacaataattccattgagttatataagacacatcattaatgtaggaattgtaacattttcattgtttcattattgatcaagtgatgttagtagcaatttgtaggcactcagatctatctttggggattaatgaatgaagaaagaaacaaaagttatgcaagctttcacattggactgttcagaatgccctgatagtcacattttagctgtttatgataacatatccactttactatgcaaagattttcggcatttatatgagggatttattaggaaaaatgaactttgaagtgaaaggacaatcacaggtatagagtgaaaaaaggtatgatgtcaagaagagtacaactgagctaaaaatttgtgagtttatagaaatactgtaagatttgtcatctgttacatctcctcttaaaatgatgaaaccatataatggaatttattttgaaattgaccatatttctctcttaacaagtatgtataccatggtattgacatagaattagattgaactattactatagcatcaagttggctatcaattgttttatttaaatgcatacagaaataatgaagcataatgctagttgtgaaaaacataaacaaatgtccctggctcttgcttaactaacttctaatctattactagttataatgattagttagaataatattaatgtgtatatacacagaaggttttatggaaaatgtgattgatttcaaattaaaattgagttttacaacaggtagaaaatgcaggtgcaaatgtaattcagaaaataatcttttaaatgtttaaatagtcattgaactattagacatctacatattttttcatttaaagttaatgatctaaatatttataattatcaattaataagcagttttcagaatattgccaatatctagatgtattaaaagtcaaatccacatttattacaatatagatgaaagtgaatatgctagaaccatagaagatatcatagacatatataagataacatatactgagtcttctttctactccagggacttaggctctttcacagaagtaactaaatcattaattacctttgtatcttacaaatttcccaattatatactcatatacatgaatttatatataaacaaatatagacagattttttttacacattggacttttctatatattatagatgcttgtttcactgaagagtacaactttaagatctttttatattagcacacagaagtctactgcattctattcaacaaaagtgataccagtgcatcatttccatatgggtaatttttttttagtattttcacatcaactgtattatttattattttttaaaattaattcttatctcaatagcttttgggatacaaatgtttttttttacatgcatgaattatatggttgtgaattctgagattttagtgcacctgtcacctgagtagtgtacattgtacctatggaggttactttatatgatgtttattacagaaaacattgcaataaatattcttatacatgtatcttcttattcttatgtaagaatacatatataagaatatatacataagaatatatatacatatatgtatgtgtatatatatgtatatatatatatgttagccatttaagtcataattctgtgtgtggtctttattttctaccttcaaataagttacttatgctattttgtcatttccatagctgaaaaaaattccatgtgttatctggaagaccactttttttttcccacttgacatttttcatctctatttgaaaaactctctatcaaatgctcaaagcatgacaatttgtaagagtaaattgccttatagcacacaacacaaaatatccactaataccaatgctgttttatttttatatttttaaattaactaatttattgattttggtagagacaaggtctttctacattgcccaggctggttttgaactcctggggctcaagcaatctgcctgccttggaatcctaaagtgctggaattgctgacctgaaccatcacaaggctcacaaatgcttaatttttaaagtagtgatagtctgcccattcaaaagagaagctagtttacttatactttagcaaaaaattaattaaaatatgccttattggagatatatgtagtgcatcataagataaaagggatgaaatataaatcaaagtcaagattaagacattttctgtcttcagctctctgtattttctgtgaagaaaatactgttacagcactactaaaattattttctggcctcttgcaaaatgtacctaatgctagttatttaattattgtagttagccaccttttcatatggattctctattctcattttattttacattcctttctttccagtctttttacctcttgtgcaacttttcttattatggttccaattttcatttctttatttgttctctcttgggaaggaagaatagtcatatgtaaaataacatattgaactttctgtcttttaagtatttagtgtgtattataattacagtagcgatcaattctatgagtagatttttttgtttccttagctgttttgttcatatttatttttctgaaaatgaatattacagttcttcccctcaagaattttatgattgatggatataacattatcattaattggagaaaaaagtgcagataaaagccatggaagaaaatgtcagaagttttagaagtgtgtatgcaaggaaaaaagggttagagagatgaatgattgattcctactcttccatcttgagtacctcatggataaagacaggatatttgtgctccaatttttagcagccacctgcttttctgctccccaaaggggaaaactagtgacagtaacatatgagaggaatgtccagaagccttgtccaaatgctctgcgtcatgcagattggcctctttgtgtctccaagtgagtcttctaggcatggtattcctttacacttagcatttattttgctcagcagcacttaaattcataaaaacagttatagcaaacatttctagaatatatcagaaggtagatcttttcttttttaattttcaggaaaaattatacaatataagaagataggctttagtcagataaatcttaaattcagataataaggctatgaaatgtatcacgttactcaatttctgtgatgtctctgagctttttgtcataggcgtgctggagagatgaagtgaccctcctcagttaattcttttgagtattaaatgagataatatgtctgaatcactcaaaatatttagtaactgttagtttttttcataatatcctcaaggagaacttgggggaaatttcataatgctcccaatttatggtggtaaaatgaagacattcaatgtgaaaattaatctaaaatgatggaacagctgtactcagtgggattcatctgcctcgaattctcaataaagttgaattgaactatgcttttgagatcttcaaactccccctggcccattttctgtaattcactaaaactcacaggattcggcacatagccaaactaacggctatgattgattacagcaaaaggatacaaagcaagatcagcaaagggaaaagccacatccagagaaaactcagtgcaaccttccaagaagcttcttctactggagtcagacgggacacacttaattcctccagcaatgagttgtgacaacgtgtacgaaatgtctactaggaaatcttgcccaagattagaagtttaggatttttatcatggttcagcaaacgccttctgtcaaatatatgccacatttctagtctttcagtaggaaagccaggtattcagtataaattatttagtttttacaaacagtttaagcacaatggactcctattatcatttagagaaagttttatatccgtgtagggaactatttacccttcaagttactgaatgccagtcaagcgctaactttgcaagccgtccattctaagaataacagtctcaagcttactatgttaatttgtttttgcatagatttcatctaaaaacagcagaaaagagattaagggaagggctcagagagagtagagccaacatgaacagcaaatctgttatttaagtactagttctaccctatgtagtcattaaaacactgtcaataaacaagtgttgcaaacctctctgacatattgaaaaaaaaatttacaaatgaagccttataattatcagtggtccacaatctaatacgttttcaatttacttacattttattattaatcactaggtataaaaacaaatccagcaggggaaatgtgatagatccaccatgacatccgtaaacacaacactagatttaaaaacaaactaacaaacaagaaacagaacaaataataattaaaaagctcttttctccaaaatgatgtttttaatttacctttgtattcatttgggttttgattattagaatatcctcacccttttctaaccctttcctgatacttgattttttggatagtttactattatgtcatttgtgttttttgatgagtataaaacccattttgttaggagaagaaaagtccccattacctgaactgttgccataaagctcctaggaaagtagaaaatgcccaaagttattttcctttttcttctcttaaaaacccctttccaataaaaacaaagaattggcaagcagccattttgagagcaatcagtattggtaaagctgataaaaagagaaacatctttgaggctgtggtcccttctctaccatccatgtattttagtacatcaataattattttttgcagagtgagaaattcaggaaactgggcactttgctttcctaagctaaggagatagggcgcagaatgtattttcttatatctgaagacccttgtggatgatgaaggaattgaaatgccacagtaacaaaaactacaagtataattattgattaacattcttgagggataagatgtgccagactgtgttctaagcgctttacctatgtaacctcatgtcattctctaagtgaaccctatgtggtaggtttttattattatgattattgtcttccaccttttgaggagaagaaactacaaacaaacaataaaaaactaaataaattttaattaaaattaaaagttaaaaaaacaaaaaaaggctgggcctggtggctcatgcctataatcccagcactttgggaggccgaggtgtgtggatcacctgaggtcaggaatttgagaccagcctgcccaacatggtaaaaccccatctctactaaaaatacaaaaattagctggccgtggcggcgcaagcctgtaatatgagctacgcgggaggctgaggaaggagaatcttttgaactcgggaggcggaggctgcagcgagccaagatcgcgccactgcactccagcctgggctacagagtgagacttcgcctcaaaaaaaaaaaaaaaaaaaaaaaaattaaaacttaaggaactgagacaaggtgtcattatacaagtacccactgcaggagcagagcagacattcaagcactagcaccatggtaccagagctcatgtgttgctgttttaggctcacgtttgcctcagtgtctttctggggtgtttctgtgtgcacgtatgaaaacaaaatgtatatatatatatatatatatatacacacacacacatatacacacacatttatacacacatatacataaatgtgtgtgtatatatataaacacacacacatatacacatatatatctacttgtacacgtgtgtatattataaaacattttaaaaaatttaaaaatatttaagagcattaatcagttaaatcagttttaagccaaaagtattacagtgactcatttcaataacacctttaaaaaaaaaaaaaaagcaaaacacagtgaaacttacaaaaagaaagagtaaaatgctagttgccagaggctggggaggtggagatattggagacgtgttgttcaaacgacacaaaatatcagttagacaagaggaataagttcaagagatcttttatacatcacggggactacagttaatatattgtgtacttgaaaattgataaaagagtagattgtaagtgttcttactgcacacacacacacaaaacaaacaataataagtatgtgaggtactatatatgttaaaaagtttgagttagccgttccacaatgtatacaaatatcaaaacgtcatgctgtacaccataaatatatacaattttacttgtcaatgaaaaaaactgcttattttccactattcatctaaagtaaaaagaaaacaaaaactattatagttaagtgcttccacatattaaatatctgaaaagataacgttatttttcagaaaaaaagcaaacctcccctccgtgatcattaaaaagattatttatatatgcatctttaaatagatcgcttttaagtttcacctccaaggtcatatttacttaatgacttggaaataagtgataagatagtctttactggaaatgatttaattctctgccatctagctaagggacaaatatttttgggaaagagccagatagcagatattttaagtttcaggggtcaatctctgtcgcaactcaataccgccattgtagacatacataatatgtaaatgaataactgtggctgtgtttcaataaagctttattatgaatgctaaaatttgaatttcacttaattctttcatgtgacaaaactttattcttcttttgatttttctttttaccattaagaaacataaaaagcattctgagcttaaggacactagaaatctagccattgaacaggattttgcccaagagccatactgtgttgatcctggatctggataacaagaaactgctaggattatctgtgattgctttgccttgctaaagtctttcttttgcctatagttacatacgttattttgtctatagctatatatgctcattattttatcatctaatgtatcttttttaaaaaactgttttcaacttttaagttcagggggacatgtacaggttattcagttttgttacataggtaaacatatgctatggtggtttcctgcacagatcattccatcaccaagtattaagcccagcatccatcagctattcttcctgatgctctccatccccctgtacctccaacaggcactagtgtgtgttgttccctgccatgtgtccatatgttgtcatcattcagctcccacgtatgcgtgagaacatgtggtatttggttttctgttgctgcatgagtttgctaaggataatggcccccagctccatccgtgtccctgcaaaggacatagtctcgttccttgttataactttatagtattccatggcatatatacaccacattttctttatctattctatctttgatgggcatttaggttgatttcatgtctttgttactattgtgaatagtgctgcaatgaacatacacatgtatgtgtctttataatagaatgatttatattcctttgcatatataccccatattgggactgctgggtcaaatggtatttctgcctctaggtatttgaagaaacaccacgttgtcttccacaacggttgaactaatttacattcccatcaacagtgtaaaagcattcctttttttatccaaaaccttgccagaatctgttgttttttgactttttaatagtaaccattctgactgctgtgagatggtgtctcattgtggttttgatttacgtttttttaatgatcagtgatgctaagctttttttcatatgtttgttggcatatgtatgtcttctctggagaagtatctgtttatgttcattgcccactttttaatggggttgtttgtttttttttcttttaattttttttaagttccttgtagcctctgtatattagacctttgtcagatggatagattgcaaaaatcttctcccattttgtagtttgtctgttcactctgatgatagtttcttttgctgtgcagaagctctttagcttaattagattccacttgtcaatttttgctttcattgcaattgtttttggcgttttcatcatgaaatccttgcctgttgactatgtcctgaatggtattgcctagattttcttctatgactgttatagtttggggtcttatattttagtatttaatctctcttgggttaatttttctatctggtataaggaaggggtcaattttcaattttctgcatatggctagcagggaatctttcctccattgcttgtttttgtcaggtttgttgaatatcagatggttgtaggtgtgcagtcacatttctgagttctctattatgttccattggtctatgtgtctgtgtctgttctcataccagtaccatgctgttttggttatggtagccttgtagtatagtttgaagccaggtattgtgatgcctccatcattgttctttttgcttgtgattgtcttggctatttgggctctttcttggcaccatatgaattttaaaatatttttttttctaattctgtgaagaatttccaatggtagtttaatgggaatagcattgaatctataaattactttgggcagtatggacattttcatattgattcttcctattcatgagcatgaagtgtttttccacttgtttgtgttctaatttttttgagcagtggtttatagttctccttgaagaggtcctttacttcccttgttagttgtattcctaggtattttactatttttgtggcagttgtgaacgggagttcattcataattctgctctctagtttcctgttgttggtgcatagcaatgctagaaacgttttcacattgattttgtatcctgagactttgctgaagttgtttatcagcttatggagcttttgggctgagatgatggggttttctagatacagtgtcatgtcatctgcaaacaaaaataatttgatttcttctcttcctatgtgaatatgctttatttctttaccttgcctgactgttctggacagaacttccaatgctatgttgaataggagtggtgagagagggcatccttgttctggcttacaagggaaatgcttccagcttttgcccattctatatgatataggatgtgggtttgttatagatggctcttattattgtgaagtatgttccttcaacatctagtttattgagagtttttaacatgaatgaagattgaattttatcaaaggccttttgtgcatctattgagataatcacatagtttttatatttagttatgtttatgtgatgaatgacatttattaattgcatatattgaaccaaccttgcatcctagggatgaagccaacttgattgtgttggataagatttgatgtgctgctagattcagtttgccagtattttattgagaatattcgcatcgatgttcatcaaggatatttgcctgaagtttttttttttttgttttatttttttaatctctgccaggatgtaacccatgtcttagtgcattaagaaacaccagtgcatggaggaagtctactaataatgcacatgtccaaataatcacagaaagtatatctatttatttatttaaaaatctgtaactttgttcaaaatatttttctggaactggagtatcttacagcagtaaaaatatttcctaaggtaaaaccaattttagagtatataccacttgtaatataatctacctttcacttgatagtctttatcgaatctttcacagaagtagacaggatatgaatgaatgaatagataagcaaatgcagacattctcttcattttatggaggcagtaactgctattaagtggtgttatataatgtactcaggatctcagaacaattaatcagcatggcctggctgcacctcaattcttctaactacaagatacttttacacctaaagcagctagcatttaattgactgttttaatagaaatacagggtgattaccaatctacttgatcctttttcaattctaattatttttctaccaaataattgcacgttttgagagtttctaaatactcaactgtgtgtataaatcaatgattaatttttccttgattttaataatgaaaatagagcttcatatgatcaagaacctgaaataatacagttcaattaacataattccattaaaaacaaaggaatggaacagttaatctattcgtcgtcactgtgagacatagcagatgttctgttaggctgtttgaaatattagaagtatttcataaggctcctatatctgtttttctagactacatattgagaactgctgtaattacagtatcatcctcagtgttagatgtaaaatgttaagaaaaatctgtccatctggcaagaggaggtaaaagtttgttagagtgggcagaagttaggtctgatagcacctaggtctagagaaacacaaactccaggtaatacatatattctagtaaggtttgctccatttaaaaaatacaaacttatagaaacagaaaggcatttattatgctcatttagtagcaataaatgccttctaatatctttgaaaatttatcatgcattctcttcttaaatgtcttcaatgtgtacagagcccatagttaataacaattctaattattaaagaatatttccattgatttcatttaagtctctggtcctgcaacctccatttgttgatttttggcttggccctttggaataactgctcagaacaatcttatcttgtacataaaattgctttagttattcttcataagatatgatttctatgtttatgactgcaatatttatagccaacctgtgaagagcgtactatttgccaggcatatttctatatgctttatgtgaatcaataatttaatttttataatagatcaatgagttaagttgtattaccatttccattttcataatgagaagactgcgttatcataaggatcaatagacaaaagtcacaccaaagtcacacagctggttagtaagtaagaaaaagttttgatggttggaacaaagtctcacagctagttaaacagggagccagaattcaaactcagacagcctggctctagactaacacgtttattttgtgctttattaaatacccagttattggattatccttctggctccaggttcttttttaaaaatagctttcgtatgatctgagaaatattcttacatcaaatacatttgtttgctctctctttgagatttcacacacagaaaaaacataaatgctcaatcattaaaggtggtgaagatagctctttctcatcttgtggtcctactgaaaagtcattaagaacaagaaatcctgtccaatgccctgttataaaaagtaatgacagtaaagaaattattctgagcaaaaccaactaatttcaacagtcacagcaaaaagtcaaactcagatgattcaatttactcattgatgtagaaacaggagaaaaaaacatatttgaatcagatgatcaatgatcaaggaatgatgtgtttcctgttaaataattcttaattaaagaggaatgtttttatagtttttcaatagaacatcttgctatgtattattatcttgagtcatgctcactgtttttacatactataaagtttaagacatgttttactttcttgtcttaggaaattcagtaaaataaataaattgaattatatattttttgatcattcagaggtctagcattttttattttcttctaaatataaattctcattatgaaactctgtaaatgtagaaactatggaacaaacaatatatagaatgctctttggagatcaaaagaaaattaatctttttcaagtgattttgaaaatgtccattctagtggaaggaatgctagccaggtagaaaatgagggttctaaaaaaactctgccactaattcacgtctttcctcatttgctaaaataaaggaatagggttaagtggccacaaattccatttagttctttagttgcattattagaaaagtgatgtttgttccttatttttaaagtgtgaagagcaaaaccaaaactgcaggtatttgaaattagctgtactctctttaatatagtttattgtgttgatgcattggtctcataagaatcaaagcctgcattctccgtgccggttgactttggagcactaatgagttgtaagtgcatttattaaaccagtatcactccacggcctaggcctttctctacagagaaaagagctaatgaaaggaactaatgaaagagactcgagctaatgaaaacaaaaatcaactcaacccccaaacaatggtgtctggagtagctgaattatccttcctcctaaactaagaagtgtctcgcatttccaaaccgtcagtactctattgtaattgcttttgtttggactacaaagtgtttgggggctccagaacgtagggtgattagtgatcccaatatccatgttctctctgctaaattgaatttagcatatttgttacaggtgatccctggggcctttgtacacacagaaagaaatcaaattaataattcaaaacgtaaaagctatctgttggtctctcttaacttaatttgtttggggtcaggtccacaccttctaattcagaacgcgatttcagtgactcttgagctgtgatgctcagtgaatggagagtagaaaagctcgaggagacaaatctccttaaacacaataaaaccgacagtgggagaatttccaaaatggggttgtgattgaaaatacacattgacaaaggcttctctttacttctgcttttcataatataaactcaaatatgtgtgtacatatatatatttaaagtttcagactgctgtaaaaattagtctgtctatggatccagagagttcatctatatcatagtggaggaatgtggaagatgagtgagaaagcaagcatgaagtcatgagttcagaaaagattgcaaaatgcttctctatacagatggtccctcatcacgctgtgttgtggagtgtcgtacagacaactgtgaaaacatggagagcagagtcttgtgtcttaagccatgcattgcctggtgcaaatgagaactccgtcatgatatgttgatttgaataaatgtatgtacacaaatgtaatcattttagaagaagcccagtcttacaggcataagcagcaaacctaaccacagcttccacctttcaaaagtccttcttacggtgctgaaggaatttattttgcattggtttgctggaaagaaaataatggtcttgactattacagttctttactttcttccagaaaagcgaccatggcctgggtatggttttcagactgcatttttacagagtatttaagggcaaaggggcatttatttttgccaaacagactgaatttcacaaatgatacatgaggattagtgaatggtgttcactgtagcattaaactgctttttttatggccagataccattccaatctaaatctgcagaagctattcatgagagaattacactgtgaggttacatttgggttggttctactcaataaagtgacataaaaagaagagccaatgtagtcaacagaatttctaagaggcaatcttattagttttcttatttataagcgtggctaaagcattaatggtgctttcacagattttacgccattgtgaatgcatgttgtcaggggactctctggatccacaggctaattttcacagcagtctgaaactttcaagcatggattaaaattatgcttaccctttacttactattagttcataaccctcaacatttatgtgaataatctaagtttctttataaaacatagaacagagtttgcaggcatgatacgcttcagaagaggtgggagcacaattttaggcaggtggtgaagaaattttgaaacaaattctgaatcaaaatttgtttagattacaaaaatagaagatgatattgttaataataacggcacaattatgtagtttctgcttaactgtttcagcaatggattaaaacaatattagagaaggttaaaacaatagaaattataatagcatatttctttgtagtaaattagaaatttaatatatattgttttatacttaattcctggggaaaaaaaagaaacttgtggcagttcagagtggattgcaataggatttattgaatcccctatgtgtgccaggcactcattcagggccgctctgcagggctttgtgatacacaaatcaaaagtgtgcaattcacagaaacttcaatgcaaacttttctctctctctctttgttgtgcaactcaggagccatggaagtttcttatttgatatagaaaatcaaaaggtatagaagatgaagtttctgcttttgagaaatttctactatgaggggaataggtgttacttttcaggatagtctcatggtcagagggttaattaacttgcttttggccaacatagctagtgggatgagtatataaaatctgaaattcagatggtctaatttaaaatttagtgttattaacattatattgcattaatttcttttaacctaaaactttgcaccaataataaacttttttaacttataattcttgtaaatttaactcctctctccaccactgcaaaaagtgcttggcaatgtgagtaccagctgcttttagaccctgctaaaaaactgtgcccaatattttgagtttccatttcagttctgcgtcttgtgacttctagttaaaagaattgtgtgcctttgtaagcgtagagtttgtacgaacaaatgatatgaaatcagttagacttgacatctaattttacatccgttagttatttatcagctgtaaacatctctagtagaattttaaaatctcagttccttgtacataaagggtcattgaagagaccagtgtttcggagatgtttgggagtataaatcaggcagtatattatataggcacttagtacatctgagagaattgataaaaacgtgtgtatgtcatgtatgctaatcacttcttagtaaacatatatttcaaccccctttatttaatgcttttatttggacatatgttgtaggagtcgttcctctcctcacaacaagatatgatcatgctatcatatattttaaagagttaagttaggaaatggagtcaattctcaacaggagcttatctgcagtagattgctttggtcaaatccaagatatacatacagctagtaaataacatacttggtaaatgatatgccaagatttggctgaatccaaagcctaaacttgtatatttaccagtatatactttctttttgcaaacaatccagttattgatcacatttccctataatgccgatgagttattcagcaaaaatatgacagtttagggaatgtctacattattcttaatttataatatagaaaatactgttaattacctataactagcaccatgtatctctcctagcaatactcttagaataaaccatagggctaagtccgcataatactttggagattttatgttttttgtgatgggtaagtgggtaaaaaaatcttcattccccatacaaatagatgatttttgacttagattaataatcagtgtctacaaaagaggtatgctcttatgttcttgctattagcaggcatgttgatgtggctatatatgttgcagtggtgataataaaaatgtggattcataatttttcacatgtatattagaaaacaacatgtgacaatgtctgtgttgacatattttccaaatttaatataaaacaaaactatttcagttttaaaaataagcacctaagtaatcacaataaggggagataataggaaaatttaaaataattcacatacttataaaatacaataggtaacataaagcaaaatgataaatacagaaaagctaaaaacaataaaacacagtttagaagaaacaaaaacacagagattatttgtatcctggaaacagaaacctctaaaacttgataaatatttttaagaacctaactttaattttgaaggatgcagtatgaaaacaatttatgaaatttcttaaacaggacaatagcaagtgcttggtgtataaactctatggaacattaactataaacatgttattccgttatattaaagaatggagaatataaaactgagaagaggctaagtagactgccctgttgacaagcaatatctaaagctgtattgttaacatttgttgacattgtagaaatattagaaagacaagaatctctataaattataattctaaaccatgggtccccaactgccgggccacagactgatgctggtgtatggcctgttaggaaccgggccgcacggcaggaggtgagcggtggcaagtgagcattactgtctgagctcacctccctttagatagcgttggcgttaggttctcataggagcgtgaaccttactgtgaacgtgcatgagagggatttaggttgcgcgctccttatgagaatcaagctaatgcctgatgatcttgggtggaacactttcatcctgaaaccatctaccccaacctcaccctcctgtccgtggaaaaattgtcttccatgaaatcagtccctggtgccaaaaatgttggggacgactgttctaaacgacaaaactactatttcaaagatataagcatagctcatgtatgtatgtgtgggttatacactattataacacagaataaaataataaatgccatattgaatcaaaactatatttcatattatctagtgaaatgcgtaccatgtttaaggtgactagagataattttggcatctatttaccattctccctcgcattcatacaaaaatattatggttgaattgtaagtgcattgctcaaaaatccttctcatgaaacgtaagcttatttaaaccagtatttctcaatttgtgcttcattgacacttaatcctataaaatggcaaactaaaaaaataattgtacatcaaaataagtttggtaaataatgaactttaaaatttctccttagatgctgggataaatatattaatgcctgctaaacattccatttgtttccttatattttctagcctgtttgggcactcaaatttgtgaggagttatggccaaaaaatgtgatcaaaagtgaagtggattttggactaagacactggaaaactcatgtgcaattccccaatctcgtttttttttttgtttgtttttgtcccctttcttaccggagtaagggaggaagccccatgttgcagatggtacaaccacaaaataacagtacctgtattagccaggggttgttatggaacagaacatcattgctatcccatgatggggacatagggttaacaatatacacatctttattgttaagcccctaggagttcagggtttgctatcgagacgtaatctagcttacattggtcatatgctatacattatacatatgtatatcttactagcaagcccggaatgcctagtatacatatgtgcaattcgtatcatataataaaaaactcttagtcttcatgcagtaaagggaattctcaaactgtttctgtcacatatcctacagttatttatccatagaagctttttttttttttaaagagtctattcatatccccttgatccagggttccatggaacacagcttgtgaaacactgattttagatggtttttcatcttatttatttcattatcctttttagcaacaagggatcaaacactgtgaaggtttactctctactggataagagagtaagtctatctttgcccaaatattaccttcagaagtttgggctacatatttataatgagctgaaaacttgtgttcatatttatatttcttttattagtttgcattttaattatatctaatttttcacattttcagacatggtaggttattttcatgaaaatagcaataatactactaagagtttctttttaaatagttttccaagtctttaatttagttgttctttcctggattttctagaattcttttactcataattgaacaccaaaaactatttttacaatggttgtacaatataatttctaaaagattaagataggttttttattgagctttggttgatatctcaaaacatttagagtggacaccagggaatactggaaaaatagggattcattttgctatctagttctttctctcgggcacacacttgttgaacatggtctgtcatcctgagcatagattttaatgcctctaaaatcatttctattcttcaggctattttcataccttaagaagttttcttttctaatttattcatgttagctttacattgcattttcaaaaacagaaaacagtgtaggatttcattatatcactttttggattatttattactaaaaaaaagtaccgccacaggtggatggagtatcttaacattaatacatctgttctcttttttaaaactggagagcacatttctccccagagaaggggactatgtatcccttccttatatttccagtgtttaagatattcattttttaaaaaacactctcttcaatttcaaagacatacaccaaagttatgttttctctcatatagtatgcttgtcaaagtgtttagcagcttatctattgatgtagatgccactaacttctttgacatgaaaacatttcttattctttatttctcatactgcttttagagccagtagctggccttcttttttcccttaagtatgaatattcatcaaggaacttgttggacatttttttgtttgtcttctcttctttcctcctggtattatatatgtttatttagccttaatcattacttcaaagtagatgatttgaaaattgtatgttctgtccaaatctcatctaaaaactcaccccatatttccagaagcccccaaacaaaatgccatctgcatctacttcttcatatttgaagtttaatttctacaactttccacaaaacagaattttttccttattttcatatatatatgggagcagaatgactcttgtcgtagtcacaaaggttccaacttgattaagcactttagagaggtacttaaaaaaacacctttccttacattgtatgcaaaattagcatatttttctggatttatgaaacaatcccactttcaaataatctctctcggataggcgtggtggctcacacctgtaatctcagcactttgggaggcctacgccagtggatcacctgaggtcaggagttcgagaccagcctggccaacattgtgaaaccctgtctctactaaaaatacaaaaattaatcgagtgtggtggtggaaacctgtagtctcagcaactctggaagctgtggcaggagaatcgcttgaacccgggaggcagaggttgcagtgagctgaggttgtgccactgcactgccctgtgggcaacagagagcgactccatctcaaaacaaaacaaaacaaaacaaaaaatctgtcctatattaacataagtatattaaaatttgacagaccagttgctgtactttttggattggtttttgaaaacatagactttagtagtaagaaacttagtggagtaaaagtaaatgaagatgagtacttttaaaatttaaagtgtggtcagttaaaacttatttaacctaacactcaattaagtgtatgaaaagtgctgagatttatccattaatttttctcataagaaactagatcacgtatttcttttaccaaaattctatttgacattcaacttaaaatccaaagagtgtaatgaaagcccttaagataatgactgtgaaatagcaatatagcctgacgtttaatgaagtggatgggtatgtctcttacctaaagagaagatgtgaaaatttaaagtcacactggttatgctgtctgtgtgtatatcttcatttttaaaaaaatcagactcttgagaatttcattacctagccctccaccaaaacaatgcatctgcgtaaatatttcacaattttccattgttttaaagttggctgatgagaggttacttagtactgtttggtatttttcccaaatcttttataccacaacccggaagtacccatgcctcacttgtggtaacataaatacatagattcatatttctgattaagttataattattattttacataaatatcttgtctagttatctgaaaaacctaatattagaatttaagatagggagatgttagttcagtgaagcagtatcttcattaccaaatacgtaatgtgattgttgattgtacatttggaatgtcacacagttcattcttgttcccactggacataaatcaagatgttacattgacaacttgtcctacaagtctaaaataagagtcagttttgtcagaattgtaggcgtatttcacttactcataagttgaagattttggagagatgaacgaggtgatcagaggatacattcaataatgtttttgacctttatttaaaccctgtcagtatgaaaacttcagaataaaactataaacatatgtaatgagtgtgactgtcaggtcaaaaattcaaccgtgaaaaaaattttctctggaagacaacttaatatctttcttaagccctattcttctgggttggcaaaataaaattttttggggggtttgtgactaagtttcagaggactttcatattgcaagacaattcatatgcaagttgtcctcaagtcatctctctatgcggtatctcctgaaagaactgtctccctatttggtcttcgattacagatacacatcaactctcttccctgcccacctgttcctttcatttaaagtggccctctctgctgctgattacatgcatggccatggagatcattctctggtttccatccatggatgtcagtgtctacaagatgagttcattggcctaaacctggcatgcatttcctcttgctgatgctctggagtctactgaggaaggtcctctttgctcttgaatctcgcattcctctctgggtttttgccagttcccaaaatctctacctgagaagaaggcatggagctcctctcagcatcgcctctcatctcttctgctgtgtctctcttttcttcgctcctgggtctccagctggagacaaggacacagagatgatcagatatttactagtttctgcattattgtctctttcccaagaagtctcatggaagaaacaaacaaacaaaagagggtaaaattggaaaagataaaacatgtaaagatattaattttttgtatcttccttgtaagcttgacatcattctctttcaaaacacaaaggtactgtcatgtatttgcacatccctcatgtcttctgtcattatttactcttctgaaattatttcttctcttggaggagtactttctctgtgtaattttcaaatgttgtttgtgtatatttctgtgtgtggcaaaacttttgaagtcttctattccaaagagtatatatatttcaacctcactttcaagtgatgaaatatctatatataaaactgtaagccacaagttatttttcttttacactttagaagggttcatccttatcttcttgcatcgagggtttcttatgcccatctaatttttgttccttgtttcgggaagtcttttgaatgtttgcactttctttacttaaaatatactatgatacatctaagtgtaggtttttaattctaaatgttatgtgtgttagtggtgagataggtacaaatgcaatagaggaaactaggaaaaattctcaatccatttggggtgtgtgtgtgtgtgcgtgcgcatgtgtgtgtgtatgtgtgagtgtgtgtgaaacaccttcctccaaatcttaatcttacaggtctttttacctcatcaaaaaaactcagtaggtcaaaaactctgtgttgaattggtacctcttgaaagagcctgatgccccactaacatctgtggtccatcttgaatggggacagcttatcacaatagaaggagctattgatcgtgacttatccttgagtcccctcctgctcacttgacatttttgtggtatcgtactagccctgcacagcacacctagccctgttccgtggatttagccttcaggattccaacattagtacttgaggcttgaggactgaggaggtgagtgtaagcactaagcattcttcttgtcttgggtgcagatttcacagtatttccaaagattcgttcatactccatggcttgtgcttttgaagtttcgttttcattaaaaataaaaacatgggccgggcgcggtggctgacgcctgcaatcccagcactttgggaggccgaggcgggcagatcaccaggtcaggaaatcgagacaatcctggctagcacagtgaaaccccgtttctactaaaaaaaaaatacaaaaaaaaattagctgggcgtggtggcgggcgactgtagtcccagctactagggaggctgaggcagggaaatggcgtgaactcgggaggcggaggttgcagtgagtcgagatcacgccactgcactccagccttggtgacagagcgagactccgtctctaaataaataaataaataataaataaataaataaataaataaatagataaataaaagcatggtcaggttttgagaatgctgacatgactaaaaataattatactttacgaccatcttttccctgtaaagttaaatggtaattgcataatcgtatttagaataaaagagagtttcagagtgtgcctctgctctttccacccctttcattcataccactatgctcaggcctccctgtttagaaatttggggactactcctgagatacagagtgagaagaaggaaaaattaggacaaagccgtaataactcttactgctcccagtatttgcattaattttttgtgttaaataatttaatccatctaacaaccagtttataacattagtgaccacagtgtcgtcattttgtaacaaaggctatttggaaaattaccaaaacccaaaactgagtaagtagcagagctatattttatattcaggttttgtctgcctgtcaaccactttttttataaagaagacatctagattaagaggcaaaagacagagctgctatcctagcgctgtcaatagtgtgatcttccataagccatataatttctttgtgccccaattttatcttttgttaattaatagcataaagccctattctagctggtttgagcattaagcagaattacataagtatagcctgtgaatatggctagtattatcacagtgttctgtatacattagctgaatttcagtttgtgaaaaattaatccatatcccattttctcagtagaataaactgtctaattagttggtatttatcatgttatttatttatttattaaatttttttgacagaatcttgctctgttgcccaggttgtagtgcagtggcacaacctcggctccctgcaacctccgcctcctgggttcaagcaattcttctgtctcagcctcctggaactacaggcactcgccaccatgcctgacaaattttcatatttttagtataaacggggtttcaccacgttggccaggctggtctcaaacgcctgacctcaagtgatccacccacctcagcctcccaaagtgctggaactacaggcatgaaccaccgcacccagcctatcacattttttaacacagtaaaaatgaactgacttacatgaatcagaaatttgtatagtgtaaagatttactaataatttaaaggatacaggtaatacatagatacaggtggaacatggcctgaaggacccaggattcttcctaggtggatagatacatcctggactggatacatctgctggaccaaagtaatggatgagccattgcaatgaaggtcgctgttcacctcatgtagccagaagtatcatgaactgttgccactttactgatcattcagggattacatgacattttccaagagcacatgcttcataaatccatagatcctctctctcttttttttttttttgagacagcattttactctgttgcctaggctagggtgcagtggcatgatctcggctcactgcaacttctgccccccaggttcaagcgattctcctccctcagcctcccgtgtagctgggattacaggtgcctgccaccatgcctggctaatttttgtgtttttagtggagacagctttcaccatgttggccaggctggtctcgaactcctggcctcaagtaatccacccgcctcggcctcccaaaatgctgggattacaggcatgagccacccaccgagacacataagccaccacgcccagcccatggattctaagtgtgttcacctaagtggttccacaccagggacattctgctcaaatcatttcataaacaaaaaaacttccttctaataagtattagtacagtttccaggaagggtcagattttataccagagtcaccaaaatttttatccagggagagaaataaaaccaggctatgttcaacccaatcctctccatgtggccaaagtataatgagattgttgtaataaatactgcagtaaatattatgattttattttttatgcctgacgttgttgtaactgtaaatggggcaaaatcaaatcaagtatcatagattgagtagctgttgtgtacatggtagctttgaaaaaagagaaatttacttgtgatcaaaattcctttcaatgtctagaaatgcttgcctcttcttatgacatgataccattcttatctttgaaacagaataccttatataatagaaacctagagcaagcaatttcacatgaggtaacaaaagagttcccagagtttttccagatcagtggaagacttaagtacaggatggagggaaattttaaaattgttcaaaacaagaaagcatttccccattagagaatcaaataactgaagagagggtgtgtgtgtatctctttacagtttcttttctttttgctgtttatgtgcttgcattatcaagacattttcccaatatcctacttttattttagtagcattttcaaaatctgtatcaaataaagatagcaagtagtagagcaagatgaatgagggagggagaaagaatggattggtagtggaaacaacatttcccacaagcctatttattgtagcattgacagtaggaattcttataaatgctaggttaacttgaaattctaccaaatgtctgttactgtttgttttaaatagaattctagtatctcgggtaggaaatttattacaggcaaccctaagaagatatattccctaaactctccttcaggtgatgggattaatcttggtaaagtgactaagttgcttcttgatggttggtacattttgaaaaagaagaatcacattaactccagagcagaaaagaaccgtagatcattcttactaagttcattggtcttacatgtaaattgagaaagattgctgaaggcaagattgccccaaggaatttaacttgaaatcaagaggctacataaatgtaaagtgctactgcttaaataaaaaatattatgttttaataataatcatgataatatgacacagtatgaagcaaatatagtgaaaactagaaaacagtcttggaaacagttgctacattgttattaaggactaaaccaatttagaggatcgtggctgtgaacattttaatatcccactcagctccaaattatctagagaaatcttctacacattctacaatatggaatgcccaaggctgagggtgttgcagaaaataagataaaaaaaagaaattatatttgcaaccagactagcactttcttcagaacactgtgatgtcagtttcacatcagtgaacatttattcttaaaaacaaatccctattattctttgcctcagtggtcactgagctaagaaaaagaccagttggttctaggggaaaaaacaaaacaaaacatgtgagacattgaaacagtaagtgagaagttggtgaaggtagctcccaggtggattctgtcacatgctgatttattttcaactctgaatatttagcattgcacagaacacttgagcaactcttgaagatccttatttagatggctggagagaaatctacttgaaatatacagtatactcacctatgagtcctgccctacctcaacaaaatattccatcgcttttattgttctatattctataaaggcccaaaagactgactatggaagtggactgcttacaacatttatcttagtccagctctgtatacagcatattaattttagactttttaggtattcaaaaagtagcaatttatactaactatggcttcaatacctagcaatatttttattttattgttaattttgctttaaagatatctattataaagagaaaaattcaaaacagtatcttaggaaggcactggtcagcttgcctaagaatacaggtcatattatgctattcaagttacatttcagattaatatacttctgctagatttatgctgcatctaacatttgggggaacaaatggatgtattaatatgattttaaatgctgctctgtgcttaacttttattgctcaatggagagtgtacgccacagcacagttatgccaagaatatggtttcagtaaaagaaaggagctaatttattgtctcaataactagctcttttcttatttgatgttaaagaaagaaatgtgcatgtctgaagttgaggttcagcaatgcattagtatttgccaaattatgagtgacccttctaaaggctataatattttagtttcacctattatgttatatttattttagaaccaatttacaattttcaaattgtttcctacatttttattagttttatgatgtaacatagaatatatactgacaaagacaatattattttctttgacattacataaaccaaaaaatatgcattgttataaaatatgagaatcttgcaactgcaaatcagaattgagaagctttcatgcttcattaacacctgtgctataaattcaggtttaacaatttgatgaaggaatatttcagattgcaataatcacagaagtatttattttaatagtttcaaaggccaagcagaaatctgttacagttaataaacatcctaaaatggttcgtgtatgataaaagaatatcaatggtgtttactcattactctggggattgaaattaaatcatataaaaaaactgtgtttaagttccatatgcatttgttccttaattgtcagtgttttgaatttacgtcatacgcacatttgaaaaaatggggataacaatttgtgaccttttattaataatattggcttccaaaattggatgataataagagagtctctaagagcttatcttttttcaacaggaagcttcctcttattcttaatttaattcacaagattcccatgaagtatgtaacttgaaatagcatttactgagtaaagaaaaatggttaatgctaccaacaccaatacatatttaatgattgagaaatggctgttaactatgacaaaactatcaaatcacaaattaagaggtgcctcagaaatcgattgtcatccttttatccacatttagggaaaccaaaacacagaaaagtaatgacaattttctaagacaaaacagcttgtcattccataaagtggctactacaattgggtctcctgccttccagctcaaaatatttcccctatactctgtaatttcagaagggggataaagaatataggattttttttttaactttttaaagttatttttatttccgtctcttttattaaattctttgtttatagaagattgcacttaccgttgctctgttctcatattttataagcactttgtttttgttttttttttattatactttaagttttagggtacatgtgaatataggatttttacagtaatcgtttgttaaaacattttatttaaaactaattaagatgcatggaaatttgcaaagttagtgcagagattccatgcattttaaactactttcctctaatggttgtatcttaccaaactagcataataaatggatattggtatgatgtttgtgtaatgtcgatcacacataatcactgcaattggaatatagaactattctgttaacacaaaacttttcttcacactacacctttatagttaaaaacgtcacccatcagccctatacataacaacttatatccgtctgctggatgtagaaaccttgactccctgtaagtccttttcagctttgattatcccagctccatcctctttcatctctttttctgttactctgatgacatgaatgctaaatctgttattacagtgccacagctccctaaggctctgttcattcttattttcagtctttcttttctgtgttgccgaggcaaggccattgataccattctttcttctaatttactgattctttcctctgccctatacattctactgttgagtagatcctattgagttttttattttgcttattatattttcagttctaagattttcatttggttcttctttatatcttctatttctttgttgagactttctttcattggtttcaggaatgtttattatttcttgttaaaacatttttatgatggctgctttaaaatccttgtcagataatcccatcttctgtgtcatcatagtgttggtatttttctattatattatgtaatttgtggcccttttttcctcttgtgcatgttggtatttctgggttattggcttctctctataagaaaatatatgaagcaaaaagaaaatccaaggaattcactgccatgtatcctcaggtccctatgtccccaatgaacctatcttttctctgcttttcagaatcttcttaatggatgtttcatctacagtatcaatgacttggggctgcagttcacagaaagaatagagaaattatgtgtactccatcttggagttgaactggtagccctagctagccctttgatatcacaaacacatatgtgataatgggtattattgaaagaaaggaaatatacttaaaacgacatttaagatggcaccttagacagaattttgcatatttcatgaatgcccctaatattaaactggttgatatgccttttagtatgatgacaagctttagttgacagtcgtacaaaacctgtgattttacagatttcaatcagtgatgattgagagacggcactatcctgtcagcacagaaccatgttccttgtattcaggtgaatgaagattatttttattagtgatgtacaatccagttgatttctgtggagcactgacatccaatctgcctagttatcagtccactatttctatacagaacacaattttaatgtcattcccgtgttcctcagtatatccttacattattaaatacggacattatgcaagttatttaccaacactgtttctacgttgtaccttttctaaaaagcttttcttttccaaggagataaaacaacaacaacaacaaaggtaatagtcataatacattttaataattaataacatgaactttgagctatcttaaagccaatattgcattttaaagaaaatatgacatttagctgtattaatactttgtgttttatatcttatagcagtttcagttatctattgctgcatagcataccaccccaaatctgacagattttaaatgacagtaatttatttcttataaatttgtaagtatggaattctgtcagggccaagctggttagttctattccacaagggtgggcaggatttactcattttctgcattaagctggtagctgggatgaaatttccaagaaaacttgattaacttatatgggacctaacttcctcgtgtggcttctctactgcgttagttttgttttccttaagattcgaaacagacttctaagagcatacaaaaatggaaacctacaaatcctcttaaacgaagccacatgttgtctattctgtcatattttactggtgaaaacaaatcaccaagccagcctaggtttaagagaaaagggatagactccacctcttgatgaaaggaaagacccaattttattgtaaaaggcatgtggaataaaagatattgttttatgatcttatcttcaatttttttcctcttggaaaattaacatttttgaacctcagggatttttacaaataatttgtaaattaagtaagcaattttcggtcttttaaaataacacatcacgtagattgaatgggatttcttatttcataatttgtaaatagagatgctgttattttcatagtaaaaatatttatttatttatttatttatttatttgagacggagtcttgccctgtcgtccaggctggagtgcagtggcgtggtcttggctcactgcaagctctgacccccgggttcacgccattctcctgcctcagcctcccgagtagctgggactacaggcaccgaccacatcacccagctaattttttgtatttttagtacagacggggtttcaccgtgttagccatgacggtctggatcccctgacctcgtgatctgcccaccttggcctcccaaagtgctgggattacaggcgtgagccaccgtgcccagccataaaactgtttatttctaaataattgtaattggtcagtgcagttgagcctttataatgtttagagaatctatgcccaataacagagattttaagagtattcagtcgatttcccttttctctggcattaactcaatcaaaccatctcactccttcatgtgttgtatagattttccaggcttatctctgacctttccaccactccacagcctacactcttgacataaacaaggccagctccatggggatgcgacctatgcattccacagggtgctgaactcaaataggctgcacattaggtatagtgctctgctgtcactgtcttgaaattcttaatcattttttaacaacgggccctacgtttttattttgcactgcgttgcacagattataagccagtcttgtttttatgtctagaatgagctttctatacctcacaatattctactggacaagttttcaaacagtcttcaagactcagcttaaatatcattttgattttcaaaattattctaattccctaaccctagctatagaaggaataagaagaaataaggtctcttctatatatatatatacgtatatatatacatatatatatacacgtattctatatatatatatacgtatatatacacatatacatatatttatttatttattatttatttatttattttttgagatggagtctcactctgtcacccaggctggagtgcagtggcgcgatctcgactcactgcaacctctgcctctcaggttcaagtgattctcctgcctcagcttctcaagtggctgggactacaggcacgtgccaccatactcagataatttttatatttttagtagagacggggtttcaccatattagccaggatggtcttgatatcttgacctcatgatccacccacctcggcctcccaaagtgctaggattacaggagtgagccactgcgcccggcctcttctatatattttgtcttcataccacttaccataaacttctattataataattgttttattattatttgtgtattcattttcatcctccattagttgggtttaaaaagcatgatactcattattacccacttagtaatttcccagtacataatctatgacatgtatagtaaatattcaataaatatttgattgaatcaaagaacaagtgaatagattaatgcaatgtagttatgtatccttctttaaaacactgtacattgaggtacggtataaatttgttcgataacagtgtttgccttatatctctagtgaaacttctcagttatatttttgtctaattctctttgatcctcactggaaatataagacatcttttgttatcagatattcaatcgcctttatacagttattacttgaacttaaattctttctttaaacttaacttctcagagataataaaagccatgcatgtggtttaacatttacttttacttaacatttgccattctgtatgttttattaatttatatttggaaactcatctaccactagattctaagtccttgtagaagcttttacttccagccaaggtggagtagcagggaccaaatttgctctcccctctgaagaaaacatcaacttagagaaaagagaatatgaaatagtgattttgcaagactctgaacatgagtccataaagctgtaaatgaataaagtagcatgatctttgacaggttggaaacaaatttgaagagacctacaacagccccagctactgtgtggaaagaatgattccaggatgtcatgcaggtccaggaggttgtctgttgtctctctgggttgaggcagagcagtcttgaaaggccaagctggccatagtccttagagaagactggtggagaggagagcactgcacagaaacgatgttccagagatctaagaagaaaccctccggaatgttcagtggagaactgattcgggagtgtttgaggaaactatctgaggcaggtaaataactactgaaatgattaaaaggaacaattcctgaagctcgcatagagctcaaactatctgctgcttattcccacaatccagagagaaaagtctcataattcatggggcatgggatagagtttgcatcagtagtaaagcaaaattaaccctacactaaatgctgctctgatctcaactaacaactttcaagcaagacccaaaatgtttccaagtaacttaacttgtcataaatgaagcttggaatatttctaggaaacacaaatgtccagatccaatgaggtaaaattcacaaggtctgtcatccaatcaaatgttgccaagtatgaactaagcaggaaaatataacctagaatgaggagaaaaaaatccaaaacaatcaatcaatactgaccaagaaataatactgatgatcaaagtagtaaacaagaacatttttgttttactattgtatcccatatattcaagaagtgagaatgatgagcgagcatgaaaattagaggtacagaagatataaaagagactctgatttaacttctagagattataaaatgcataggctgtgactgttggcagcttagagattgtaaagatgagtgaagttgaagacagcaacagaaaccattcaaaaggaaacacaaagagaaaaaaatgactgacaaaaaattaacagagcatcagtgagctatggggcaacttggggtcctaaaagggtggagaagcaggagaaatgtttgaagaaatgaggagtgaaaaatttccaaattcgatgaaaactatcaattaaaagatagaaaattttcaaaaaaaatagaagttcaaaaaaatggaaaaagctaaagtacatcattatcaaattggttaaaactaaagataaagataaaattttaaagttatgctataaacttcttgagtaggattgaatgtagttcaacatagtgacatacacaaaatggctgcttattctatactagtagattcattttatcaaataaaatcatttcttgttatagatattttttaaaccttagatctgtcggccatttcttagtattccttagtatgaagtatttcttaccccctttacgtatttctaagaaggtaggtgacatataacaaataactttgaaataaaagttttagtttgagtttgtttacgcagaagcaagagattttgcaaaaggaacacttgttttcaataatgtaatggtctagctgatggtcaactgactcaccttttaaaatttttactgtgtagtaagaaagttgggaaggtagtgtgaatccatttacttaatcctgggacacgttaaaaagaggactttatgaaagtcctctttagtgtataaataaataatactttatgaagtattgtataaattagtatatacataatagtatatataaaaataggtatacatgaatactgtatgaagtattattttcataaggcagctatattgattgcattgctgaactgtaaaaatgattgcaaaccaaaataagagagatagatagatagattagatagatagataagatagattagatcatagatagataatagataaaaattaattgttttggaaaaatttggaaataaagtgaatataataaatacatatatatgttagcttagaactggcatctgttaatggaaaaattgtattatacttttccctcaaagttccttactttctctgaaaccagcctgtatataacaatagccagtccgtatatggctacgcagtttatcctgatgtagttgcacaccttcctttgtgccctgaatgtgggctctttgagatccactgctgttaccaccatctggagactgctcgggctcctctctcagtctgtggttttatgtcaaatccttttatcctttaatttccacatctgtacatcctccttagcactaaggcatcttttgataatgattataggcatgcaacattgccctagatgtaaatcaatcatggcaaatacccttgcagagaacagtatctctctataaggacatacaaaagaaaactgtattatgcttgaaaagaaatatttctgagatcactttattcttgatctctgaaagtcattttaatcctgcatttttattcactgatgtatccttgtatctgccatctctttctacactacatccttttatttttcccagggctaagtacccgtatgcttttcctttcaatttcaaaatgtggaccagatgttgggacataagtactagtttggaacaaacatctgtgcccttttcaggcaagaagaaatgagaatgaggtcaggcatctggttaaggacacaggaggcatccctgtctcgtttcttaattagttcttctaagaccttctctcattctatacataatgtttataatttaaaattcatagggtcttatgttgaaagggagaaaccactgtgtggaatataaaataaaaactcattttacagtggaaaaataatttaatctatccagcttattatttttcctgggcataaagaaaatacaataattaggtagctgcatattttaatagcttttaacgctgattgtaaactcaatactgaagaaattagtggtcagttggtctttctatttttattaacgaaaactgccaatgagaggaaagctaatttaaaaatcgtacaagagtaaccttaaaagtgacttaaaacatgaaatatataaaacacatgagccacttatgctgttataatttctaaagttataccatattggctataaaccatgaattgatatgaaatctgagcacatgcatacatatcactcatccttatacaagtggagagttttttcttaaaaaaaagggggaaatgtttatgtttcaatatacttgttccattcctaataaatgaaattcattgctgatctccataatgggaattcttggctggtgtcagattaaatgtgaatttttggaagtttgtgaatgccagaaaataaaaggtggttgatttccaaaatcaaaagtaagatactttaggtatgtatgtatatatgtattttaatgttttcagcaaagccaactaggaacacaaaaagcaacagcagactagcaaatcacaacaagatttccgggtcagtctgctggtcaaatgaaagttcttatctacctatgatttaggtgtaactaggaaagcaagttgcttgacagaactgaaaatagaacaaaaagttccagattcatccaaatctgaaagtttagatatggaaaacttcctctgcttgggctttatataaattttctgaagtctcacagatcctttcaaagggtttgctgttactgagaatagaaataaaatctccagattcctcaaaatctgagattctaggcctggtttacttgttcttttggagttttaatttttaattaatcttctcccaaacttcccaagttctccttaaggcctcacatcagtttttccagctgtgatgctgtgaagcaatgccttgtcagcatcaggcctaaaagaggtcagtatccctttaaaataaatcttagggtttcactaaaaaaataaatatgtctataagcattcagctgaatgtggatgatttatgcttctatacatgcaacagcccatttgcaattttgctttaatgggatagagaacagatctaattagtataaagaaattggtaggaaagacagtcttagaaatcatctaatccacaaagtataaatgacaactttctattctttgtccatataaaaatttttatgtaatttaattaatatttaaatgtatttttttcaaactgcattgcataacaccttgatctttattctactggcctcattcagattaaagttttgcagattttgatgtggaaagcactatggaatcaagcctgagaggatcagaatcatcatttgtcatttgctaaatgcaatgtcaagtggtaattcaagataaatgccttaaagataattctgcagtcacagacgtatttttagaagtgttgaattagatttcatattctcaacacttctgtgatctttatagaaagtgatggacatatgaggtacataaactatagatagttatgattgttttagaagctgaggtaaagtgtaatgtcatcaagggactgcatgtgatgaataaaactaatgactagaaagttaatcagtgtgaatattcaaaaaatgattatatattcatttttgaagctataaatgaatcaaattataatttgattcatttatagcttcaaaaatgaatatatatatatatatatatatatatatatatatatatatatatatatatatatagtcacccaggctggagtggtgcagtggcacgatcttggctcactgcaacctctgcctcccaggttgaagagattctcctgcctcagcctcctgaggagctgggactacaggtacgtgccaccatgcccggttaattttttttatttttagtagagactgggtttcaccgtgttagcaaggatggtctcgatctcctgacctcatgatccacccacctgggtctcccaaagtgctgggattacaggtgtgaacaactgcgcctggcccaaataatgtatttttatgtttaatttgcaaaaattattatttttatttatttctcaaggcacatgagaaaatatcaaaaattatttttaaaaagcattaatatataatatgatcatcactcaacaatgagttactgtcatacacttgtttgaaggctacttaaactatccataaaaggaaccaaatcatatcctttgcagggacgtgaatggagctgggggtcattatcctcagcaaactgatgcaggaacagaaagccaaacacctcatgttctcatttacaagtgggagttaacgctgagaacacatggaggggaacaacacacactggggcctgtcaggggtatgtggggagggagagcatcaggaagaatagctaatggatgctgggcttaatacctaggtgataggttgatctgtgcagcaaactaccatctcacatgtttacttctataacaaacctgcacatcctacacatgtaccctggaacttaaaataaaagttgatgacaaagaaaaaaagactgtgagatgcatgttagattattgatatctaattaatttcatttaataaatgtctattaagaaaaaaatcccatctaatacgaaaaccacgcaggaatgtacaataacaaaatcaaagattcagtcaccctcacatgcatctcttttctggaattttggtttgtagcacatgctacaacattagacagtagggtttatgtggtacaatttttgtggaacattagattttacatatgtcctatacacatacatatacatacatacaaatatctatgtaaaacctgattcattttgtgtgccaacttgactgggctatggggtacccagatatttggttaggtattattctgggtgtttctgtgagtggtatttgggaggagactgatacttaaattggtgggctttgagtaaagtagattgccctccataatgtctgtgggtctcctcccatcagttgaaagcctgaatcaagcaaaaagattggcttctcatgagcaagaaagaattctccttcacaatgctcactgcagatttaggacttgccaccctcgatgattggctgagctaattccttataatatgtgtatttctctctatatatacacatcctattggttttgcttctctggagaactctaatacaatacccacataaaatatgtcacttcttgttggttatgaaaatactcttgcatatcaaaaactctcagcactacttaacaatcagaaggcaacaagattatatttctttcaaatgtaactcacagattcccctcttaattcctaccatgtaatggagaaatcaggcctgcttcatttacaccatctttgcatgacttctactcaccgatgaaattgattttctcaaaatagcatcaacattaaaatttgtcccatggatgctgactccttccatggttttccaagaaggagaaaatatatagatggttatgtgtaggtccatgcgtgtgcattttaagaatacgaatttccacatgctgttagcaccagtcatgtgatattagctcagcaggtattaccacctcactccctcaggtagctccaattgcaagagtgatatagccaaaacttacaattggaacctggttataatatcaacatcacagcacaaattgcatgtagctcaggtcactctctttacttgcctccttgcttcaaaggaactaccttctccttgcaaatttacccaagcctataaagtgcatggagtgtcagagaataaaatacttcctgaacatgacatttgggtaaagtttgattgtctaattattatggaaagaggaaagggaaggacgcacaaaaagccacaaggaggttttaaaacacaaggaggggccactggacaagcgcggtgcctcacgcctgtaatcccagcactttgggaggcggaggcagatgaattgcttgaggtcaggagttcaagaccagcctggctaacatggtgaaaccccatctctacaaaaatacaaaaattagcctggcatgggggtacatgcctgtagtcccagctacttgggaggctgaggcatgagaattgcttgaacttgggaggtagaggttgcagtgagccaagttcaggccattgcactccaggctgggtgacagagcgagactccatctcaaacaaaaaacaaaacaaaacaaaacagaaaacaggggctactggatgcttgtgagaggcagaacagaggaagtttaacaacaaaatggcggccaagcttgggatttagaactattggaacaagagcagattcctaaactggccaaatctcaggagaatgttgacaacacctgtgataggttatatataaattaatatacaaattttgaaattgtcaggagaatgaagtctagcttcacagcaaaagcagttcaatacattacttgttttaataaaaaattataacaaggattattaattcttattaagtgttaacaagcatgtggagaaaagggaattcttgtatactgctggtgggaatgtaaatcagtacagccattataaaaaagacagtatgaaggtttcacaaaaaattaaaaatagaactactctatgatctagcaatcttacttctgggtatatagccaaaggaaatgaaattagtatgtcaaggagatatctgtactccatgtttattgaagcactgttcgcaatagccaagatatggaatcaacccaaatgtctattgactgataaatggataaataaattgtatgatatatatgtatatatactacaacatacacatatataatgaatatactacaatatgcaatgaaatactatgcaacctttaaaaagaaggaaatcctgtcctttgtgacaacatgaatgaactgggaggatattatgctaagtgaaataagccaggcacagaaagacaaacactgcatctcacttacatgcagaatcttaaaaagtgaacttacagaagtaaaatgtagaattgtggatgtcagtgtctggggtatagggcagggaatggggagatactggttaaagggtacaaaatttcagttacataagataagtcagttctacagatctattgtactgcatggtaactatactttaaaataatatgtaatcatgtattatgcttttgaaaatcgcatagatcccaaatgttctcagcacaaaaacaagtatgggaggtgatggatatgttacttgggtggacttaatcatttcacaatgtacacatagatcaaaacatcaccactgtacaccataaaaatatgtaatatttatttgttaataataccttaataaggctgggcgcggtggctcacacctgtaatcccagcattatgggaggccgaggtgggtggatcatgaggtcaggagatggaaaccatcctggtaacacggtgaaaccccgtctctactaaaaatacaaaaaaaaattagctgggcgtggtggcaggcacctgtagtcccagttactcaggaggctgaggcaggacaatggcgtgaacccgggaggtggagcttgcagtgagccaagagagcaccactgcagtctggcctgggcaaaagagcaagactccgtctcaaaaaaaaaaaatataataataataataataataccttaataaagctggaaaacagaaaaagaaatttagtaagaagatacagtaataacttttagtagcatttgtttattgctttgcaaaaatctttaaatttttaaaataaatgtgattctcacagaaaaattatctaagggagttagaaaactgtagtggaacgtgtctagacaagaataggtgaattgtctgaattcaaatctagtgaggagtagaatcagacgttggtcccttaccttttgactccgtacactgtatgtggtaaagaatatgtgaaaaataggattcagtacctgtctaaatttaagtgtatttgggatagacaacttaaatacccacactagacagcattaaaagtcacataatgctttcacataatcatttgtaggtcagtgttctggaaaaaaggaaaatcaacgtagactaggctatttttatgtcaatgtaaactgtcactgctaaaaatgaaccagaaatgtgaaagataaaatattttcttgtttcctaataagcttctctcatgctccatggttatttttattttttgaatacagtgcaaatattactttaaatattctaaattttttcttagagtttttcattgaagaaacttctatttggcgtagtgaaaagacatattctctgaggcttgaatgagttagaagacctccgaaaaataggtgatatgatccagagaatagtttggagccaaaaagaataataccacatgtcactacctggagtaattaatacttcttggtgtgtagcacactgttttatctctacttaaaccaaagcatagccttgttttgttgtataatttatcagttctcttttcttctttgtttctcctttacaatttttcttctctttcttcaagaagagatctgaatgagaattagtatgtttactagctctgactcatatgcagaaccctgataaagaaaacagatgatcctctatttccctacacagccacattctcccccttctaacttcacacataaagggaagttgattattatccagacactgtcttcccttctgaccttggtgttttcctttccgagcatctcaggatactaatcactagttgatctctttattaaagtaacactgctcttgatattggtgtgagatgcactccattagtacgttttgttttcagaatatctcttatcaaagccagatataatatagcacacaaaatagtatgtgttctgcaatatcaagaaaggagattttttagtcaaaatatatcattattactggataaatacacatgaggcccacgcagagttcttgacattggaaaaacttatttactccttgtagcggggaatagtatgttgacttagtagcattgtggatcacatgattgatcccttgcaacagtttgggcgtctctctcatcatctctttctgaatagtccagaaattagtagtagttctaaaaattacttaaattacccaacatcaggctatttcctcaagtcttctttagagggaaataaccagattgatggaggaggaaacaatgcatcagacattaaccttcccccttgcaggtgaggtaggcctacactccagttcgtcatgggagcaagggaagggcagaaagaggaagttgaatagactagaaagtattagaggataaatgggaagaaatagagggaggaaaataaaactggaaataaaaacttaagacagaaataaaaacaaaaaggagagtgatgaatacaagaagagaactgttatcttgctcaattcttcctgtctctgataatctattctatgtttcctcaagggctttgttatattaaatgagttttgccagaattatgtgtactgttgccatgatttccatgtattcacctttctttttgaattcttctgtctcttcctccttcccttctttttgtctcctgctacccccattagttccaaattctaagcaaaggtaatctactcttcagtataaatgaatgtttctgtccagtggaatcaatatgttaaattatcttgccaacctgttaaccacgtgtcaggaacattgttcttaaatgtgattgtgacaaagcaactagatatcacagtatacaagtaatatatatgatacacacacacatatacgtacatatatacatacgtgcacatgcatatatacacatgtatatacatatatgcacatgtatgaatacgagtaatatatacacatacatatgtgcatgtatgcatgtatattatatacatgtatacagatatatacatatgtgtatatgtgtgtatatatatagagtaacttaaaatattttgacaaaaataagttttcatcaatactagattctaatatagtgttaacaagtgctaaaatttaaaaaaatgatggcaggtttgtaaaaaacaataaaatacaatctattcacttatctgtttcccataaaaacagagaaaggttgacatcctttgtttggtgtggatcactattttaggtgagcctgggaggaatgatttgagaagcagtgctttagaatatctgaatttgagaccagatcaggaaacatggatatacaatgtgtttgatcctgctattattttaaattttctcctacttattttcttatattcaatttggtcacaatgcattttcaaaacaaagcgttcattttttgaccacaaaaaacagttcgttaatgaaccatctcaacagaatacttttattttgctcaatgtctttcctttgaaactgtttttttttttttttttttggctctctttcttttctctccaaacaacaaacaaatgaaaccgcaaaaaccctgtcaatagaagtaaagtttttaaggcagatttattgtctttcctcctccctatcagaatatttaataagggtgtggctttggaaggaaattgtctcagtgatggcagaagaaatctacgtaacagatcatattgaatatattgtcctaaaatgaattatttcagagaatagaagaaaacctcttatttgttaactcatctgccttgtggaaattggaaacataagctaattaacagtaatccataaaacccattagaggtgtagatgggaaagatactttttgaagtagtaagtctgtaaatacatagttgcaccttcttccctctttttctcttcctcctccttctcctcctccaattccacagctaatattttcactatttgcgaacttatcatcatttttaatactgaacacgttattctgaagtgatccatcttgcattctaatatcgagtgcttcataaatgagcagcctagcaccacgcttagcacactatgttggaaagtcttataaatgactttgatcacaaaatgttaagaaaaagttgtttccagattggctgggcaagcgggaatgaatttgagagttgtttcactgcatcattctggttgcaaatactctcttgaattttaatgatattgtagcctgcctcagtgcttggaccccatcaactttacttccattttctagctgccttttctgcagtctatgatcattccatttctgaacctagtctggtgtctgctttaattggcctgcttttgtgatttgttcagttagattggagcttttcagaaagatagtcagaagccctgcccatcaccgtatccccagctgaagcctctttgactagtctaaacatacacacacacaccacacacacacacacacagccctttatttgtgtttgtgttttctagtgcaagatgttgcagtcttgagtccaaatactcagaggctataaaggcaacagtagctagctaaatttttccccactaaaaagcaaagattatgaagtttgtttttttaaagggattaaaatgtggcagggtagcaaaaaggactcagattgtggaatggccttgagcaaagcattaaggtgcaagtctgcagcacagaacagtcagaaacctacccagctgtgggtcttgttcttcctccatctaagttccagagctattagcagttccagctctaactcttcaatgtgacttttagtgaggtgtgtagggtaaattgaagtcctaggtctcatttgtagaaaagtattaggtgggctgttccctagtctgtttgaatcatcaaatcatagaatttctgtgcattccatgtatgtgtggcagaatcacttccctttacacaagatggctaaatgtttaaccagcttctggagaggcatttaaaaatgggatcttctgagactttgcatgctgtcttcagacctatcttgtttcagagtactagagattgatacggcaggataggttattataggaaacatattttcgtagtccagaaaatgagaatttatttggtttatgttgttgtttttttatatgattctttggctaagacactaagaatgaaatctagttattgaaatcaattttatcaggaattatcacatatacggtgtatgaaaattattatctggaagttggaaattattttctttgctcttttgttgagtcgcttattgacttaagtggtgtttgctacttacctgagtagtgggcatttgaattccaggactttgattggacctctggtctggttttgactgtttacgctgggctacaccataaaagctcgttgggttctaaagactgagggaaatgatgatgtaaactagaatcaaaaagttgtttttacttccaactaaccagcaaagaagcgattcttgaataccaagtgaggggattaggttcccttcacttccctttctttttggtaaaagctgatacaaagtgaaggatgcaccgggtcagaggatctgagaggtgagaattctgactttcatgtgagtggctgggagtgggatcacatcagctttcaaataagtttttgcagcatcgctattaggaattctgtgctgtttcgtagaacttcatctttcctatacacaatttcgttacagcagggctgcatttgaactacaacaatgcttaccaaatgtgtttcaacaggctgttgttttcaacactggttaactgttaaattttacctaatacaaactgatagaaaggatcattactacagattagtgagtacatttaatctatcttttcacccttttcccaaattccctttcctttattcatttggacagctttccccaacaatatttattctagattccagtagaaaatgctgattttgaagtaatcaggaatttatagcataataaaagaataatagttttaagcgtaataaatgactgaaattgctcataattgtttgatgattttagtcattgaaaagcctgattaggcttcatcttctgatcagaccaattgttgaataattgacaagcaactaattaatcctaaaatgaaacagtctgatctaaaatatccctacttaatactttattgtgcttggcatactgctgttcctgtgaagacagctatagtgttttgatgattatgtgcatagctgtaaaaattaatatggtttacacatacctcttcagtaatatattttttatacattcaaatttatttcaatgtacttttatcttgtccctctttaaactcttctaagtacaaagtggtatcattgggggattaatggctatttaataatttaatgttaacaaatgacaatatatgaaagacttccatcattcaagtagcctaaactatttgcaaagaatttatgaactctatcatatttgaaaattagcgtgttaattttaatcagttttcaagtatattaccacttcttaactatattactaccatctggtcttctattccttaaaatgtagaatgttctggtaattattttgcctttaagaaaaactaatacaaaaaccaagtatttgtgatggagtcgttgacatgactgatttcagtatctctaagtaattagttaaaatatgcttgttgctttcattaaaagcaattttacacagactaatgcaaaagatgatggtagtaaataggttttcaggtcatttctgataaagttaaatgtggttgtcatttcaattgatcattctgcatcttttccagactgtccatccatctcttggaacagcctgttcaataaattctacaggaaataatttgggtgattttagagaaagtgcatccttagattaaatgcttttgggtacttttatttatttctatgatggataagaatatatttcagagtgttagtttcctgatttataattattgaatttccttgaaaaataactatttgaataaatcccaaatgaaatacaaattctgtgcatctcaaggaaaacaatgaattcaggtaaagttgatctagtactcacataactatatttacatatgctagataaaattattgattacttagcacaaagttataatgtcttcctgttattgaaatattgaataataccttggaatagtgtgagagcaatattgttcaatgtaatagtagttgattaaaaatacatgcatacatggcagacttgacaagcatcttatttattttgggaaaaacttgttcaagagttaaacagtttcataaagaaggtgcatttgtgttctctaatacaatcaggtaaaagaaaaaaggtaactagagataaaacagaaatcttgatagacagtatagaaagattttgggtgcaaaagaaagcataatattagacatctaaaattttttaaaaagtacatcaaaattatctcaatctggagaaagtcaacgaagaaaactaagaataataacacagtatgataaagaccgtgatcccccacttgtaggtaagaacatgcatcatggacataaagatggagacaataaagtgacgactactagagcagggaggagtagaggggcaagatttgaaaacctgttaagtactatgcttagtacctgggtgactggataattcataccccaaacctcagaatcatgcaatacacccaggtaacaaatctgcacatgtgccacctgaatctaaaatcaaagtcaggaagaaaaaaaaaaaaagaagacaatgatctgggtaacacaggaagtgcaaggagagtgtacaacccagtctaatgagtttcaaggaaatgtcaaaagactgtgagattgaactgactctgataattatcagtaggaatttgtcttgctgttgtgctgaagttcatgcaaaaatgctcaacacatagttttttttgtttgtttgtttgtttttaaagaatttcgacaaagaaataagctctctgctttggaaggtcggtaaaagtctaagttgcaacttaaaaaaagatggcaaagctgattcacctgttgcttctaccttcctcagtaagaataaatagttgggaatctggaaggagtttaaaaaactctgcaaaatgaaaattatagactgagataggtgaagcaaaaataagagaatgcacaaccaaattaaatgttagtctctagaacctgataatatgtctaaatactgaagaattagaaaagtgtttaaaaaaaactgtggaagaaaaagaggcacaggatactgtatagaacacttgttttctctgatgtcaagtaaaagaaatgatcagattctaaaggcaataaattgataagttaggacaatttttaaaacatttcctgaaatactgtgttgttgcaaagtaatatgcagcatccagctcctccttccaggaagatctgctgtcccagttgcaggaagtgctggaggtgagctgcctttacctgtcgccccctttggggttccctgagagtctggctgagggtcaagcccacatcacagcaacccttctccttctgaccaatccagctgccttcccctccctttcaccagtgtttgccccaaagcaaactccagtagccatcctgcacatcatctcggtcccagagactgctccccaaagaagataccctgagaaaatgttggaagcattaaaaaaaaaaaatagtgccactgcccagttaaagaaacagaatatgtataaccatttcttttgaagctcatacatgctctttctcttctcaaattgtttccacaaacttcagaggtaaccactgtcttaataattgacttttttttttttttttttttttaagatggaatcttgctctgtcacccaggctagagtgcagtgacgcaatcttggctcactgcaacctctgcttttttggttcaaatgattatcatgtcttagcctccctagtagctggaattacaggcacctgctaccaggcttggctaatcatttatttttatttttagtggagacaggttttctccatgttggctaggctggtcttgaactcctgatcgcaagagatccacacgcctaggcctcccaaagtgtgctgggattacaggcgtgagccaccaaccccagccttaattgacattttttttttttttttttgagacacagtcttactctgtcacccaggctggagtgcagtggagcaatctcggctcactgcaaactccgcctcacgggttcacgcggttctcctgcctcagcctcccgagtagctgggactacaggtgcccaccaccacgcccggctaattttttgtatttttagtagagacagggtttcaccgtgttagccaggatggtctcgatctcctgacctcgtgatctgcccgtctcggcctcccaaagtgctgggattacaggcgtgagccactgcgcgcggccttaattgacttttaaactaatcactcctctgtttttctttataaatttaatcacacatttgtatttgtaaacatcatgttttattttgcatatttttgaaatttatatacatggaatgagtctgttgatagtattctttattttgttttctttaccaaggcagctgaagatgcaagggaatagaagatgagttcacaaagaaaaaataaagagataataaataaacatcattaatgaagggcatatagagaaacaactcttacttgcaaaatgcctagcacatatgactcccactacctgatacgtccctttctcctttctctgcctggtggagacttgcccagatattgcctcttctttcctgaatgaatctttctaatttttcttggttgtgtttcttgctatccctaactgccatattttattttattttattttgtttcatttgttgagacggaatctcgctctgtcaccaggctggagtacagtggcacagtctcggctcactgcaacctccgcctcctgggatcaagcaatgctcctgcctcagcctcccgagtagctgggattacaggtacgcaccaccacatccagctaatatttgtatttttagtagatacagggtttcaccatgtcggccaggatggtcttgagctcctgacttcatgatccgcctgcctgggcctcccaaagtgctgagattacaggcatgaaccaccgtgccaagcccatattttatttttttttatctgaatcccatgtatctattttactaagtagcccagccagataagagtaagccttactaacaagaattctgtaaaaagtcttcctacctttgctttcagaaccatggacccaattaccaattttctgtttgtaacgatacttacatgggttaataaaaaatacaatattcacagaatgattgggagtggaataagaatcacatattattccccaaaaagagttagacaaatttaagttatattgaaaacaagcaataaacaatacaggtggatctgataaaaatcttaatccaggttcactagaaaatttgatgaaaacatgatctgggtgagaacttgctcttgttctccattgtttactggccttcctctgtctggccacatcctgcaacatagaagtcacttccttgaatcagagtttcagacaagtcttaagtcgaacctttgatagcttcaagttctccttattagcttgtatgagctgtatacatttttaagtcttaaaatattcttggttctctgcttttatgctataaggcatctcagctgtgaatcaacaatggagaaatagctgctgggtttaattggacccaatagtcttttctgatggcaaaaatgtaatgagttccatgatgtttgctgtgatagagcactcctttctgttccatttccatgtggccttgtgccagcataatgaatgcctcacacatagtagtttctcaatttgtgtgtgcagattcaataacaaatgaatgctcaaatgaaatctcaataagataaatggcgtgtttgaacttctcatgtaacacatatatagttaacacaaaattattttaatgataactattcagatagtgtaggcacattttgaattatccagaaaattgactttttaattcctataagtgagtgttggctattgcctaaatttgagaatttcaggaattctgtggatagcaaatgattagaaattaagatccataaatcactttttttgtgggaaatggggaccagttctggtagctgaataaagaaaattccaacagattctgtcagtttcccagatttcttaagaatctgaaatgaacttgcaagtttgaatgaaaatgtccccaaagtagtgaaaataaaagctctcatgggcatcctggtttggaaaaatattataaacattttatgtagctcaatttaactttcctacattatcgtcattctgcaaatgcaccgttacataggccactgttctgtatggtgtttcaggtagttctgtttcacagtgggtggatatgactacacagttccacattaatatatttagacctaatgtagggaatatggaggtctgcgctatatatggctcgtaaatcaataacaaatgagtccacatttatgcactatttacagtgaagttttgtatattctgcatccaaataattgcacttattatgttccatattttaaagaaaaatcacatcttttctgctgtagaaaatggctaagtagataacggatttctgaactaaacataatatgtagcctcaaagttaaagcaatacgcttgcattgcactcggataaccactaggacctcagagcatgagagttctaatcaattttgtttcatatgatttgttcatcattaatctaaaaatgtattactacccaacacttacataaccataccataaatatgaaaaagtaaaatcactacatctaacaattgatggaaatatatatgtgtatccaagctttaaatcaatatagattctctacaagcaaattcaaatattttcttttgcatctttctagtattaaaatacgttttacacaagatttgaatatattttcctttcttagccacgtagttggtattttgcaaggtcagtcagcctagctgagagtcgaattagtttgagcagatcatacttggacgatccaatgcacttgtaattctgctccttgagcttagagcctcttttaatattatcatttttatatattataattgtacatcttttcattttaaatgtaatggcattagcagtgggatactagatacgtgaagccaaatgataagtgtgcttaacatcatttgcagaatttgtagatgtttagagaggctagggaagaattatatttatattcagagaagtagatctatatttggcctgaattttcaacatttgagatttaaagaaatgttgagcctacaccttaatcatgagagttgtccgtgatctagcatctctgaaggaacgtctacaggctctgtggggaaaaatttctctggcagggtcagggaaagaaaaggcttcaactcctttcagttaatgcccaaggtgcccatagacaattctagaagcacaagagtggaaagaggtcactgggtaatgagtaaaactgttctaaggggcatgtctcattaggtgatgtctaggcagaatgtataaaaagataaaaagtccttgaattatctcatgcttttctggcttttttcttgcctcttttcccttcttcttttcctttcttcttttcctattttttcctttctactataaaaacttcaaaacagcccacttctatctttcctgtccctcaggaaaccaaataactcattggatgtttgagttgaatttgatctaaaccatctcttgatttccagggtgacaatattcttctttctttcttggatattgtggtttactgaagaaaattaatctcaataaacgcccctggatttaaactatttttatcacagtctacttctattcagtttatgttctttccacctgcaactaaaattatgcaaaccttaggcatttgtttttgtgatacaatttatctccgaatacctattttgtatgtttttccccccatttttctattcaattcagtaatccacaatgggatacagtctcctgggtcccacaggtttgtctcaagtattgttttgttcttccaaaaataacatctttaaaaatcatatttacattttgattacttctgtcttgtagaataaaagatttcaggattgtgtccaccgtacaaaaatcagaaatttatttttagtaagagccatctgtcagtcagaatctgacctagctaactgggtggatggccgaggtcattttaatgtagttggctagtaaaaccctctctactctctaaagaggcctaggttggaatggactctccatgattgggataaagattaaaatggagtgtttggagattctgagtgctaaatcaatatttctgcacaatgtatttcaatatatttcaggacttctgtgtagatattatttcagtttcaaagtgcatttatttttttttattttattaacctacttttccaaataaactatttgtttctgaatatttatatatatatttcatttatataatataaatataaatatatatttcattttccccaaaacatatacttaccactcatcttggaacaattttgagaacatttgccagaattttccagaatcccttcttattttatttatttatttgtattttttttttttaccatggtctacctccctccatatattcctttatgtgtcttgccaaacagggaaggagaatgctgttgttcttcacatgatttgagctttagcattggagggagttggcattctatgctgttatatttcctgtgttatatacaatactctgttattgcccaaagaatcattattgattttaaatgaactgtaaatcatcaatcgatctgaaaatagcacagacttagttacaatcatgaaaataacacatctttaaaaaaaactaagatcagttttatgttaattgtattttatttaagaattatagtgtattattaaataagcaaaggaaaaataaaagtagacctgactgtatctagattttgaagaaagatgttggcatttatatccaggtagaagtgtattgctcaatctgatgctgcttctcatctctacttatcactgtaaccagagggccaggtttaagacttaactgccaccagcttaggtgtgggtaactcacttgtgttctctggagcttagatccctaacctgtaaatttggcttgaaacatatgcctgagcacgagcgcgcacgcgcgcgcgcgcgcacacacacacacacacacacacacacgtacttacatataaacaaatatgtatatgctatatatttgtgtgaagatacatatataatttatttttctgcagactggatgtcaaaaaaagcacatatttgaaatattttgaacttttggataacaaatttacatgatgatgtgattctaatatattgggtatgttttctagctgttcttagcttgctgggttcaggtttctaacaggtcacctggcaatgcagtgattagaagaaacttcatggaagagatggggctagtgtcttaaagggagaagatatgaattggtagaacagaggaaattcagttcaaacatagaaaaaggaagccctgcattaaaatttgttacagtacatcttgaggatgagaagagacctatttcaatgaatgaagtggttttcatttggaaataggcagaaaaaaatatagagtgcagaggcctttaggatcagtctgtgttaactattagttttcgggaggcagagccagccattgagtggtttggacaggatggtataatgatgaaattgaagtttgggaatgattattctggcagtgaatggtatacagtcaagatctgggagaccaagattgacagactgaaaatcagtgggaaacagttgtagtgatctaaataggaagtgacaagagcctatatcacaatagtgacaagaaaaatgaaaaagaatgagtatatctgagatagatggcaaatgagtaactgacagtatttgatcatacttccagtcctcccaataccccaaaatatcacatatatttttggccagggagttggagctaatgatgttgtcacagtttgacagcagacatgaaaagtagaagtcacagagaagctgaagaatttagttttcaactaaatttatgattttttatgttgggaaattaaaaatatcctaaaggcactctaaattgaaaggtgacccacgtgaaatatcaggtgagttgatattgattaggaagctgtctctacacaggtggttgttgaaaccgaaaacggaatcagctctcactgaaatgtgtttcccattaggctatctactcctcaggataaacctagtcatttgtactggtttcagatacagtaaaatatcaacttcacctttatttttctctcttttgcctttaagtacaaatgtaaattttttcttctttagttacaagaacaaatttagagtaggttgtcaatgtctattgccaagtaattgcaatattcacccaaagaatcttgtaatattttatgctcattagcaattccatttgatatccaaaatttcaacaaaaggaaaattatacacttgtttatccaagctgaaggcttttgaagatactgcagaattcatagctgctatggaaaataaagcagcataactaactcctggtatttattttctcaaaaaagagatttgattttttttatttcttttttgtgtgactgtaattattatcattattttttacttttggagaggcaagcattttgtgctatgaattgaacgtagagttgtacacagaaaaatatttgttttcatgtttcctttccctaaaatgtctgctagagtacagatgaagattctacctagaatgaagataatcttttttgaaacaattggttaagattaaattgatttggtttaaataagactatatatggagaatctaataaacattgagacaagtagatacaacaatagtttaaagaagaaaaactgaatacatcctattcagtacaaccttagataaaatctcatgaatgaaattacttggcgagtagggctacaaaaaatagggaaatcataggcgcacatgctctagcaactatggctacgcatacactgccgcttcccaaaattttctatcaattttaaacaaaggtagagaataaaattatggatactatcttagcaagttttcttattttttttaaagtaagattgctagtgctgcatgaactatttgttttccccaaacacttgagttgcaaagaattttatttcatggaataatagaatccattaactatgatcctagagaaagagaaagttttcaattagttaatataattatatttgttacaagtcaatcagcaacaactcagtatttgaaaatccatgttttagtttcaactgaaccactacctagtcatgaaattgaggaaacgaatttatcactaaggacctcagttggcactgtaatattcattcagatagattattttaaaaacaaaatcaggtcatacatataaaatgactgtgaagactctaactgctttgtgaatgtgttgctaagatcattctagttttattatttgtctcatggaggattccattatacatattttacttttaagtgagtgataaaatgttaagcttcctaatgatttctgtggtctctagcatagagatttgttacaaaaagggatgccatattatctatgtaatcattttacataatacatggagttgtactggattaatctcaaccatttttaatttaactattactttgtagttgaacttgagcttcctctattcaaagattccagtaatcattcttcttcagcaaacacacacacacacacacacacacacacacacacacacacacacacacacatcttctggattgtatactaaaaatttatatattttggattgaaattaatttgtaaccaacaaagtttattatttagagactgtgattctgcccagattaagatttgtggcgttatgtttaaaaggaagacaataatacctaaattagatggtcagtgttaggattaaatgagataagggtcagaaagtgagtaatataatgcccaacttatagcaggtgttaaattattgtatgcattctaccgtcctccacaagcacacacggcccctcataacacaaaataagcactgaatataaaagcctcagaaagattaagtggtaggaaaagttacttttactctttggtaaccccagacagagagttggtttggggtttagttaggaaagcatcacaggtgagaaacacaagtttgaggcagttttatggcagagtgtggaggtttagtctgagtttgcggcttttctttcctcattcatatctcgtcaattaattttcccctttaaggaccctttcaagcctgagagaagagtacagaataaatcaaaagaaagagtggagagacaaaaatgaatgcagaaagagggatgcaggaaacaaaaacccagcaagtagaagggaatagtgagaataaagaaaacgagaaaaagaaaacaaacaaacatgcacacaaacaaaaaaccaccaagagagggtgatccatacctcacagtgctaattaagttctaagctggtttgacatttttgcctcctggacaccaacaccctccaagcggggcctctttgatttggtctcacatcagtagcgggctttgttatgagatctaggtattaaccccacatgtggaaagataggttaatttgactaaatatattttttaaattctccgcaccattgagtcatctaagtgtcacatctagtatctgccacctaatgttatgcttagcttctcctccttcaagtagagaaatccagataaccaacccctcccctcttcccctctacacacatgtacacacacatgcacacacacaggaaggcatgcatgcacagcacatattaaacacacaaatgaataaatagtagagtccgtggatgatttagagacatgtgaaaagtgaaagttttgggggctcaagtaatttaggagagttttctattaacatgtagtttaatgttgtctttccagttaatgtagttatataatatgtaaattaaagatggtgtctactgcctaagtaattattacaacaaataggaccgattattgaaggtgaactccttccttttctgttctctactcaaaacaatacttttaaaattgcttatttagtattgaagtaggaaaaaaataacgttgatacaataaaagaacttatttctgactggtaggtgatgataggatctgacaagggggtgtacttcagagagattgtcaggattctacacccttgtctgtgcctaggaaaacagcccaacctacctacctttagttttgaatggaggctgcaggatgttactcatcattgcttttagaacaaacacttccctttgaacgatgtcacatcactattaccatggcaacagacgccctataaagatgagttatctatgaattgtgcttctgttcaataaacacatctcttaaattcatcaggaaaaaggtttagtggaggcagttctatatattgacatttcttattctaaacctctgtctgataataaatattcatttcattaaagtgtttaattcaggtgtctttcatattagctatatcacataaatttataacagttttatgaatttaaaacagttgctttattataaaaatgatgtatttacataataaatgagattattcttatgctaaaaagcataaaaagaaaaaagaactctattctcagtgtctaaacatacagtgaacaattaatttataaaaaattaagtttatcaactttataaacaaataattttataaactttataagtatagagtcaagaattagcttaatggaccaaaaaaaacccaaaaaacttgtttcaagttaatgacttttagaggaatgcaattaagtgggtagaaattatagctccatatattttatttattttattttttatttttttgagacagagtcttgctctgtcccccgggctggagtgcagtggtgcgatctcagctcactgcaacctctgcctcccgtgttcaaacgattcttctgcctcatcctccagagtagctgggattacaggcgcccgccaacacgcccggctaattttcgtatttttagtagatacggggtttcaccaggttggccagactagtctcaaactcctgaccttgggtgattcacccacatcgacctcccaaaatgctgggattacaggcgtgagccactgagcctggtttttccaccaaagtagcaccctctgggaatgaggtaatgataacacaccgacagcaaattatttcgtagaatcatctcctcctgtctaaactgcaatctacaaaaatactttacataatagataaacctaagaggaaaatataaagtccaaaagggtaaatttctaaaacgaaattgtaaataaaagaatggaaatgattggatgccagaagaaaggcaatgagaataatttgtcagcaaggagaatgatttgattataggtaccagtgtcatggctttataaagatggttatgatttcaataggtcgcaaaaattacaatgtatatgattatatatcttaaaataatatgtaattttatgtaattatacaaaaaacgttcagcttctattctggacccttgaagaacataatattaatattttatggtgatctattcataaagaagttgatgcacctttgtagttattcttcgtcccaggttgcagaatgcaagctcccactgtcaattacacaaatactattggtttcacagtttgtgagtgtgtgtaatttttaagcaatttcttagaacctataaaatatatatatatttttttttttccttttttttttttttttttttagacagagtcttgctctgtcacccaggctggagtgcagtggtgcgatctcggctcacctccgcctcccgggttcacgccattctcctgcctcagcctcccgagtagctgggactacaggcgcccatcaccgcgcccggctaattttttgtattttcagtagagacagggtttcactgtgttagccagaatggtctcgatcctgacctcgtgatccgcccgcctcggcctcccaaagtgctggtaccacaggcatgagccaccgcgcccggcccccagaacctggtatattaatgaaaattttttttttcaaatctcagaggtaaagactagataagaaattgagtgaccaaaatcatatacttctcctaacctgaaactgccagccagtagtaaatggtttatcaactcattccagcaagtaaaatacatcagttaatactcttgcaacgtaaattggtatattgtagctcatttggtatatctcccaatattcctaattttcattttttagttcttgttaatcagtcctcaccagtcctaatcaacattttatttacattttacttattcgtaacattagaagaaatgtttgggtaatatctgtgcatacaggatatattttccaaggcaatgtagcatactggctctagaaacagatctggagtttaatgccatgtcaatcactatgtgaccttttgcaagttactcactgtcttttatcttcagtttcctgaatacaatgaaaccatctactgcgcagtgtttttgtgacaattgaactcaataatactgtaaagcacttagaacaatttttaggacataataattgttcagtaaatgtattccacctcctcatcatcatcattggaattattgcagttattttcaaccattattcagatcctattgaaaggttgaaggcttgtagaaatatatacggaatgattttcactgtcgctcggagtagcagatttatgaaattaattatccttagctccttgtgctaatactgtattatccctttagtcattttagcctggaattacactcttaaatataaccaagatccagtgggctacatcataaggaaaaagtagaagtggtgttgaggggcgtctcctgtagacaagaacaagtaagctaatttacttgaatttgactttgaatagaggtgaaaacttcaccaagaatttattgtaagtgtcccagtttaatagtgccctcagaagcctgtctaaagcaaacacaaatcttctctggaggaaagcaccttcaatctaaacttcaaagcatgcctatatataaagctcaacttactaggagtaaaacaatcaataataaaaaataatgataacttaaaaacataaagaaaagcaaaaaattgagttagtcaaagcaacagtcacaagactccaaccaagattcctagtgggtgcttcataaaaattgacaagctgaatctaagacctaaatggaagagccagaggctaagaattagaaaaaaaaaaaaaaaaaaaactccagtgaaacaaaaatttaaaaagtagaaaaagaaggagagttttctggatagtaaagtgtttgtgaagaaaaggtaaattaagggcatgtattcattttggatatagatgattttatgttttgtatgtgaatgcatatagagggatatatatgtatgtgtgtgtgtgtattatatatatatatatatatatctgtgcatgtgtatacacaaacatacactcatactcacattaggttggtcacagtggctcatgcctgtaatcccagcactttgggaggccgaggctggcggatcataaggttaagagattgagaccatcctggccaacatggtgaaaccccatctctactaaaaatacagaaattagctgggcgtggtggcacacacctgtaatcccagctactcgggaggttgaggcaggagaatcgcttgaacctgggaggcagaagttgcagtgagctgagatcacgccactgcactccagcccggtgacagagcaagactgtctcaaaaaaaaaaaattgtcataatttaaacatgaaatattttctcaacagcagatacaggagaataatagaccttgattgaataaatagatatcatggaatattatacatactcatggtcgagaaataaaaaaccttccaacagtgacattacttaatgtccataaacatttaaattattaaaagtgtttctcatttactatctcttcaatacaatatattttatttgcactggaaattttaaaaaaatatttttaaggccgggtgcggtggctcacgcctgtaatcccagcactttgggaggccgaggcaggcggatcatgaggtcaggagatggagaccatcctggctaacacggtgaaaccccgtctctactaaaaatacaaaaaattagccgggcatggtggcgggcgcctgtagtctcagctactcggggggctgaggcaggagaatggcatgaacctgggaggcggaacttgcagtgagccaagatcgcgccactgcactccagcctgggcaacagagcaagactccgtctaaaaaaaaatatatatatatatatatatatatatatatatatatatatatatatacatatatatatatttaagcacagagttgtgaatagcatgcattattgcatattgatacacattcattgttacataattttacagttaaataagtgagggtcagatattgccaaaggaagagttcaagagctggtttctaacacaggtcttatttttaaagcttgtttgtgtgtgtgtgtgcgtgtgtgtgtgtgtaatttttttggtttcctagtaatcgggagttttggaaaattatgatctcagtatgttcttaaaaatagtttatagataattccaagaataaaaaaagtttttaaatataataaggaatcttaaccaggtaaatgtatgtcttattttttacaaaaacagttaaaagttaaaaaagaaaaatagaaaaaaattataaaatagggatataaagaaaatatttttgtacagctgtacaacgtgtttgtgttttgagttagatttattacaagagagtctgaaagttaaagaatttaaaagttcataaagttaccgtaagctaaggttagttggatattgaagaaaaatgttttctacacaacgagtataatctaattgtatagtgtttataaagtctatagtagtgcagggtaatgtcctcagccttcacattcacccaccacccactcactgactcacccagagcaacttctagtcatgtaagctccgttcatagtaagtgcactatacaagtgtaccatttcttataatctttaatgccatatttttactgtactatttttatgtttatatatctttagatacacaaataccattgtgttacaatgaactatagtaacatgctgtacaagtttgttacctgggagcaataggctgtaccatatagtctaggtgcgtagtggtgtgtaccatttaggtttggttaagtatgctatatgatgttcacataatgaaattcacctaacaccacatttctcagaatattttcccactgttaagtgacacatgaccgcagtcatgcccaccaaaattcaggacataaaattgttattgccagttagaaaatattatattggaaaagtctgaatgctgtctaaaactaagaattacaaaataaatagcattcaggatctacctcctttaggtgtgagattttgttttaaacttttttgtttatattcatcagatttgcaggataacataaatactcaattatcctgagtcgtttatattcacaaaagagttggtgaatctttttcataaggatgaaaataggaatagacaaaaaagacattatactaaaacaaaaatctctgaaaccgtatcagaaagaaagaaaagaaagaaagaaagaaaaagaagaaatacatgtctgctttgaaagcacacttgttttgacttttggaaggtagaagctttgttaagaactgagttgtcttattgctacaccccatgattagagattaattgtggcatatttcttcttgaccccttgctaaagattcttcagtctgcaagttggagcattacgtctttcctccaacccttacatattcttatttttaaggtatagtttttaaaatatagttattttctgttttctttactcttggttcaaaaagcataatttagaaattgatcgtgctgataagaatacaatggcaaaagataaaaaagcttttattatagcattataataatgtgtgttatgtacgaaaaagagcaagactaggtttttttgttctttctgattttgccaggttaccttacaaatggtagtaattatcctcttttcttaactttaggcttttatgatcttgcaaagatatgacaaaaatgggaaagtaactgctaattgctattttttttttgcaatgttggaaagtacactgtgacaatgtttaaaaaaataaaacagagagtggaaaaaaatcaccatcatcaagcagcctttattaaccacttatttataaggtgatgccacggcagacaggcaggctgggagggaggatgtaagatgcattagtcacctgtgctatgtcctgtgtacttattctatcccaatgaatgtccacagcaattctaagaaatttgaataatgataccaattgagagatgaggaaagtcagctcagaggtatagcaaaatttcttatgtgatacacctaccagtggtaagtggtagaattggatttgacccagatgggtctgatttctgaacacatgctctttccttcatatttcctgtcatgatggaatgcttacttttttgaaagatgcaattcccagataacttttcagaatatagagaaaagataatcccatgaagcttttattttgagacagggtctcgctctgccatccaagctggagtgcagtggtgcgatcttggctcactgcagcctccacctcgacaggttcaggtgatcctcctacctcaccctcctgccatggagcttccttaaataataacagagtgatgaaataatctgtacaaaaaaaacccatgacacaaattacctattaacaaacctgcacacgtaccccaaacttaaaataaaagttaaaaaattaaaaattgatatagaatctgtctatacaatttaatctgtctatacaagttaaatagattttaatcttcataaaaatatgcctttcaaatgtaagattgcatgtttttctttgtatcagttagtagtacattcattacaaggaaaccaaaaatgtacccaacccacagcagtcttttttttttttttttttttttttttttttttttttgagacagagtttcgctgtgtcgcccaggctggagtgcagtggcacgatctcagctcactgcaaactccgcctcccaggttcactctattctcctgcctcagcctcccgagtagctgggactacaggcacccgccaccgcgcccggctaattttttgtatttttagtagagacggggtttcaccgtgttagccaggatggtctcgatctcctgacctcgtgatccgcctgcctcggcctcccaaagtgctgggattacaggcgtgagcaacagcgcccagccaccacagcagtcttaaacaagataaaaatctgctttgctctaagaaatgtagagataatcatgctagggttgttttaaagcaaaaaaataaaaagttatctgagacacaggtgccttccatctcttcttataggttctagagtctggaagaagggattagggtgggattggttctggctgctacagcattaacttcattaggagaaactctgggtggattgggtaagtcaccatcaggctattggccagtcatgaaataacagatatcatagaaaatcagagtgcccatggaagtctgttttcggaactttacgatgataaatgtgacagatctgggagcaagtttaattgccaggacaatctggagagctggaggcatattcttttgggagagccaagagaggtgcttgacagatggtactttgcctcaagcctgaaagaatcgaaaggttcctgtctcattttttcacatctgttcttggctccctaagtattactcttctatgtattcccctcacctagatgccaagtgttttctctaagaaaacattgcatcttttccagctgtactgtaacttcactctgtgacttgaatttaacacaattttattgcatatgaaaatgaagaggtctggagatttctctcttatgcatgaattgccaaaatgacatttctaaacctagaataatagttttctttagagaatgagattcgctaggacccacattctcttcaattaaatcttaatacgtataagtcatgatctcattgaaataagtcattgattcattttttccatattaaaagataacaaaaacggattatgatagactagaatgcaaattctaagttgtttcagtgccaaacaatgattggtacttaattttattaggaatgttatactaatgcccagttgattctgacaagcatgtctggatttatttgtaaataggttagttaatggagacatttaaaagattcctgaaggtacccaagaaataaaaacgctaagaaatgaaatcattgcaaacatatgtctcgtagttgacaaactcttcttttaaaatggcaaagtgcaatgtcctcctaaggaagctatgcttatctcttcctagactgatctacaacttaatgctaatatctttaatttctttaacaaacagtttaggtaagttacatttgagagtcaaaagtgagggcagaggagggacttggtgatcaattttccccacagcaaactgagaaaagaaaatgaacatgagatagttgacattcagaatgttctaaaaaattcagaatatatgattgccataaagtctggggaagagaggcttacgcagcatcctcaagtacagatactgtactaacacaggtaatgagtgaatggtgttcagatcatgggcacttggtacttaaagaagcgcagtgagacggaaataaggaaaagcaggcaagagcccagctccacgtgcttcatttacaatcttgcttagagtcagccctgtttaaaatggaggtgtggagagacagagagagacccaaaccgatctgtaagggacattaaaggttaatagaactgcgggtcaatgttcagagatttttcaacaagtctgagaagtgttaagaaaagaaaaaaagactaatggctaaaaccaaatatcatttctctagatttagcccactcttcagaggtcttgctttgtttcaaatttttgaatccgttaattttaaacatttggatcataccttgaattttttccgtcaaattgtatcaccacatctagtcagacacgcggcttgctcttttctttctttagtcttacgcacgtgaggaatttccactgctacaaaccctccatcccttcaggctttctttctttcctcccttcctcccctcccctcccctcccctcctccctccctccctccctccctcccttcctccctcccttccttccttccttcctcttgctttaatgtgtgtatttattattcaagagttataagtagatattaattatatcagatttatttagctatgtcataaatttcatttattgaaaaaaactgtgtgaaatcaggactctgtaggtatacctggaatgcatagtcattttaaaaccaaactctctattttgttaggactacgctaccacaaaagcttctcacctgctcctcctaccttccttctcttcattcaaccattcactgctgcctaatgaaacgctcttaaaacagaagttttgtttgtttctgttttttgttttgttttgtttgtttttgagacagggtctcactctgttttttgtgctggtgtacagtgccatgattttggctcacttgcagcttcgacctcccaggctcaggtgatcttcccacctcacctgcccaagtagctgggatttcaggcacgtgccaccacgcctggctagttttttgtggagacggggtttctccacgttgcccaggctagcctcaaactcctgggctcaagcaatcctcctccttggcctaccaaactgttgggattacgggtgtgggccaccacgctagggcacaacagaagtttttgagcttttagagacagtagtgttttctcaagggaaatcttattagggacatggaaacagagatttcaatttgaacagctgtgcactggcacagcagaaaagactgaagccacacctatttgaaatcgctaaagttaccacccatttttcagcagtttggggccatttcccaagtctgcattttaattactatcacccaacaacagttccttccttgaataattcttaggttaaaccttttttcacatgtaccctataaatatgtacaaatataatgtatcaatttttaaaagttactgaaaactccttaacatctcactattgccttcatgatcctcagtctcctttgattatattaaaagattatattgaaaatgagtaggaaatcaagtagaaatatataaagagcattgcaaaaagctaatttagtttttaacttgtctaattgaaaaccgaacctttctcttactgctcttttagtagtaataataatgtgtatggttcatgagaaaggctataaaatataactaagttttacattatccttacatcagaactctgtgtaacactgatgcaggagttttctcagccaatttgccaactggggacctccacggccagtgacacacacacccccacctgctaccagggccacagttggccttggaactgtcattggaggtgccctgcccacttggcctgcgtgtgctacagcttgtacccatgttcggcgattcccaagctcttgtcccccatccaagaagaatgaggatatgctgacaattcgaagggtgaagatgggtggagaggaattttattgagcaagggaatagctctcagcagagaaggcacgtgggggtggtctccaacccctgaagtcgggtggtttctttctcagtgtggctgagttcaggacttctatgggctcagaataggggagtgtgctgactggtttgagtatgcaaaaaaggttaaaacaaaagcaccacttaaaggtgggcatgacagtataaaaaacaaattagggaaaggtaggtatatgtaaaatcagtgatgggtagggatcaatcagaagaaagcgcatcaaatgggaagacaggttctcaatccagtccatagatttgacttgtagcttggctttcaggctttaaactgcctttggtttggaggggggatttcactggggacctgcccctacctgcctaggcatttgtctgcctcctgccactatcaacacctcacaagtttcaataatcatttgttgtttttttaactcaacaaatatttattgaacagctactatattttatatatctcagacactgttttaatcactaggaaaaaatatggcagtgaataatataaacctgtctatcctcatgaagcttatattccaaaggaagaaaaaggcaatatacaagataaattagaaaaatgtatactatgctaagtattggtaagttgtaaaataaaaaacaatcacagaatggaaacacaaagtgtaaagactgtgggtttggataaaatggtctaaacatgttttcccgcgacataacttttgagtaaaggctgataaatgtttgttgagtgaaacaggtatgaacaaaaaacagtaagacatttaagtgtagaattcaatttaacattttatttatggagtacctgctatatgtaaggttctgtagtacccaatgggaaaatactaagataaaggtgtatctgcacttaaaatatcgtatatatttgttaatacataattgattaggtaaaaataagttcatatttttagagttctctttaaattatctttaaattcccaaagtaacactggaattttaagtagtttattcaccttactagacctcagtatccactttaaaatgaagattttcaatgagcaataagattctatatctatcatgggaatgtagtactgataaatggcgaagcagataattttttctcactttgtaatggtgactttactgtctaaaatctaagccaattatgtaattataccaatggaaaaatatgctatatgtatttgtagatatttatctataaatatgctttttatttctctcaatcttttaaaaaattatattctttctagagtgcatattatatgaaaaaggcataaagatttttgcaaagcccccccaaaaaaaacaaaacaacaagcaaacaaaaaacccaaagatgagaaattataaggctgttatatgaaaataaagtttccatgtacaactaaatcattctagctacaagaacacttcagtggcattcagagcatagaatttcatcacagaatggaatcttgtattgccccttttatcccacacccgtgtgagctttggagggttgggttctgctcacttctctggtataataacataacaatgctcatgggaagtgtatcatcatgtttttcttctttttaacaaaaaaaaaacaacatgatcccaaagtaagggaaaatcagaaagtaagttttattgcctttaatatattgtatttttttttcttatggggacttttgcaactcagattagggcgttttggaattattatctgagctgcagtgtcaagagactgactccccaaagattaactccccaaagggtacaatggtgactcacatgaaggatgcacacgaaaggctttgtcacttcggtaattggagagcgtttttagagaggatgccaggcacccatcagagcattcctactctcttacaaacccagtgctgttagtgaatcttctatggattcagaagctgagatgaaactaatgtctcatatctgtggatacaaaagaagtaaagaaaatattgatttttgattttgaattagaaattgtggggtcatcctctgcctactttgtgaaacaaaatttctcacaatttccagaaaaaggtaattcatcttctattatgtgtctgcttgtgagaatttctatataagcctgcagaaagtgatacctccctgaaactctgtatccttgatctaaagatatgaggatgcaaaaatggttgtgactgttggaaaaataagagaagcctattgtcttgttttattttctggattccaagatggtaaaactgctctgattttctataattaagaaacgcaatgtctctagaaagatggtgattggaacgtgagtaaaaacaaacaaacaaacaaaacttattttgcgagttttcatccttgtgcacacaatggtgcactgccaaatggaaatgtttgctaagaccaaatacatataaaaggttgagagaagaggggggcaggaggagagagagggggagagagagagagagagacagagagagagagaaagcatgagtaactaatacgatttccacaatgtaaaaatagaatttgacaagccaacattcacttggcaaatactgtgcccttcctcatgttcatcttgctcataaaaatgtctttgggaaactattttattgaggttaggcatcacaaatcaatccacgttttaaacatttggagtttcatcttagttccttggttcttccttggagttgttattctaaacatcaatttgtaaatcttttcatatcttcttaagcaggtgtcaaaccaactcctttggcagaattctaaaagcaacttgtacgcaactctaagacagatgaatgtatacaaaattcaggcttcatctctgcacagagataagtgtgaactaaggttcatgcttctttcatcttgctttggtttctcagttgctttatctgtttttaaataaactgtgttgtgtatattgaagctatacaacatgatgttatatgatatgcatatacagtaaagtgtatattataggggagcaaattaaaatatccatcatcttaaacattttttccttttgtggcaaaagcagctaaaatctactcatttaacaaaaatcctgaatgcaataaaatattattaaatattttctgaatttttatttgaagtagtctacaaatatttactaggtctttatttcttctgagtaaacaacaccaaacaagatgagatttgtgatgtaatgaatacttgagtaatctaagcgcaatttaaggataagtctataatccaggcagacatatctaaataataacccttggaaataaagtagtaaaaggaagcacacgctttctaacttactttccttgacatgaactcagtttgagatcagtattgaacatgacattttctttttatttatatacctccgtttatccacaagtattaagtcaaaattgattttagcaacagaataaagctctgtaggttctgttcaatgatgtcaaatctatccctgacaagtgtcccatttttgctcttcctgaatagcatggcttcaaaaaaatctagaaaatgaaaaattctatagcgcagaaggttaatagtggtgaatctctaaaataagtagattgttttggagtcatgtttgtgtcttgaatcactttaaaaattttgaaaacaaaatttgatagattttgaaaaaggttatgtttgcatttctgttgttaaggtgatgtttcctggagtgatctaaaaagaacctatgaggaggtgaaataagagaactagaaaacagaagacagcatgtttctaatcccagaaattaggtttctgggacaggtaaggaaaataaagagcccaggtgtacaaaatcaataaagagcaagaattattaaaggtagttaagagagcctcactttctcatctagcatctcaagccacccactgtctctgggtgtgttcttggtaaaaacagacacttaaaagtttattactaagaaaaaggaaagagaataagataaaaatacagtcttttgaaaaaaatctgcccaattttattgacaaaattcaccatgcatttcaatatagaatgaggaaacattaaattaggtattatttgcaaaagaaaaatgctttgtatgagggagaaaataaccatacatattgagtacagtgtaccctgcttgagtgataggtgcactcatatctcagatgtcaccactatacagttcatccatgtaaccaaaaaccatttgtatccccaaatctattgaagtaaataaaaaatttaaaaaataaaaatgcaggccggaaacagtggctcacgcctgtaatgccagtacttttgggaggccgaggcgggcggatcacaaggtcaggagatcgagaccatcctggctaacacggtgaaacgctgtctgtactaaaaatacaaaaaattagctgggcatggtggcgggcacctgtagtcccagctactcaggaggctgaggcaggagaatggcatgaatccgggaggcggagtttgtagtgagcagagatcgcaccactgcactccagcctgggccacagagcgagactctatgtctcaaaaaaaataaataaataaaaataaataaataaataaaaataaaaatgctttgtatgtagtaaaatactaaaagttatgaaaatattgaataataatattttaagaagtgaaaaataaaagtttccctgaaagcataaagaatattatctttaaaattctgttacaaaatgtttacttataatttttttcaatgaaatgaagtagcattgataccctgcttacagaacagcatgagacttgaatctgaaaggcaaataaccaacagttaggagggtatagtactgtgtgatatatgtatgactgctatagattcatttatactgactgaaacacatgttctaattaacctgagtgggggtcttaaaggattcctggtcaactgttatactgcaatgcatttttctcactttatatttaagtataccccctttaaaagatggaatgctttaaaatacatttactacataggcaatttgattaatatttgtttttattttcccttcacaaataattcgatgagctagcttatgaaggcaatgcatctgcacatttaggaatatgttccaaatctagtctatgtttccatgggcatttaccaactgcatataacactcacagcaaaagctaaacaagattagtgattcccaactaccagaggataaaatcaatttatcatccattctagcagaagccatggagttttataagtgattaaattgaaggaggcgctttgggcaatgtagaaatagagcatttcttgataaaatgatgagtgaggttgtcaaatctgtgataagcctgtgatgccggctaggcaggtcagctcctctgggaccctagttacaatggcattttcttatgtttgacatgtatctggatccaagggagagaacagatttcccaaaacaaccctttattgttttctcatttccatgtcgagtaagtaaagcatacattacatatttgtgtgttttcttcgaattaaggtttgttctagctgaccacagaatagagacaataaaaattcatgatgtgggggagagttaactggattatgtcaggggaattgtttgtgtctagcccttgcctctgataattagttaccctctgaccttaggtgaatcactttcatctcctcgttttcagtttcctcccctgcaaaataatgaaggcaagcagaatcaaatggaaagttcttgccacctctaacaggtcatttttttttttttttttttttgccttcgtaaagcactacagtataagcattaaatttacttttgtatagtgagtattttcaggacgagaatagcatagggataaatgtatgcttggttttttgaggttgaatagtaaccttaaattttgttgttgttgttatttctatttgcattctaagaatatgcttgtgcagaagtgtagacgatggtgaagaaatgagaaagggtaaggcatgagaataaagacataggagactaaacaaggtaggcttatgggtacaagtggtaaggccaaatcaccttcttcaaaggtaggcctcaaaattcaccttgccagaatttcaaaagaaggtcaaaaaaagaggaaaatgagcagcaaagatctactcagccaaattgtgagtactggattaggacggattgtggagtgaggctccttcctacttcttatatttgctgggtctaaatagaagccccagatgtgccttgattgaggatggcaaaaaagtgtgaatgctctgttgaatgggacctcaccacagctcttccctgccctgatatgtgtctccaagtgtatttgtaacccatgcgacgtgaagaaaacatacagccttcttgggtgatgatcaagtctcctaagcctaaatggtctctagatgtggctctgagttcaggcggtgatgactttctcaaaagcccacaatacgcgtggacatgtgctgatgtccatgtggaaacatgctaaaggaaaggaaagttagaaacataagaagccctccatttacttcgtcaattccttgagtttataaaattgatcttttcagatacattcaccgatttagcaaatgatgataaatacattgaatttaatcctgtctggtttatggctattaaaaacaatgaattttaatggagaacaattgaaactaaaataaaaattacaatgaactagaataaaatagcacaaattaattctgccagtcagaagtgaaacattgtaagatatcccttgtgatcttctagaagggttttgctttccgaggctctggcaaactggttggaagctattgccttcctgattttcacttacttcatcccctaaaagccttcttttttttcccatatcaagatcaaagacgaaatccatgtctaccaggctgtttgtagattttatcacttatttcatggggattgaagaactattagatgatatttgagaataacagccaaatgagcatattagccattcaggtataacaaaaatggaagtcagcagtctatctttaattttgtcacatcctgtagacttaaatcatccaactgcagagcatctgttaatgtgttctcagttcttgagttatagttaacctaatgccactggccctactaagggggaaattcagaaacttcccattggaattgtggagtgggcattaacctcgagggaataccaaggtccacagtacatgtaatctcctttccacttcttaatgaccctgttttattgtgttcattttacaattgtgaaaactgaggctcagagtgaacaacgtgtcagtctctgctcttcttgtacatgcacctacttaccacttctacttattgaatctggtctcaggacttagtactttatctcctctgtttctaaatttgggttaaagttgtgtctattgattaaaaatcttaaacactgaaaaagtatgaatgcacttaaatttcccatttctgaaaaacatttactagttttctgattaaaacattgtttatctatctatatctgtggtttgtataatcatttttatcaagaattgaaggtaatgtattttcaaattagaaatgtatactttaccgtttactatttattaataaataagtcatattttaatatgcttcttccttccagtaaacaacacttctctttttttggagagttcaatgattttagccaacttcaggcttcttagttcctgagtctacagtgtacttcacccaaacttgtcttcataagtaaatccctcataatccatattcattctatactttctcttctccaacaaaattcttacctttctagtgttcttctatccgtcagaattaaaagaagaggtcttgtcaaattgattcttattgaatattttttgatgtgatttctcaagttctccctaaatgatttttttatttattctaacatgtatctatgattacttacttttaagtaatcatacatatgatttccatatataaacatatatatacattatatgtatgtaatttaatatataatatatttaagtaatcatatatatggtttatatataaacacatatatacaattatatatgtttattcaaacatatataaacatatattctaacatatacataaacatagaataaacatatatataattgattacttacttactaaagtactgtactggagttgaaataaagaaaaagatacatggaactcacagttagtaagagaagttaaaggtacaaagtaataaatggcatgtagtctgtgtagataaagcattaattgaattcagaagcaggaaatacatctggagatgatcttggagagcctatcaatgcaactggcattcacactgcttctaaaagaagaaggatttggaaatttaaagatgggaaaggatatctgaggaggaattatagcatgagtctgcctagaccacatcctcatttcccttcaggaactgtaatgaagaatttgggagcctccttggccatcttcaattacttcacagagagaaacatcaaaatttcctccaccataagcctgccctaatttatttttgttttgttctacagagcactccatttttagcagaaataactatagattgcaatgcttgaaaccaggttgtattttgtgaaaaatacttgttttaagataaaacaatttaattcacattacttaaaattctataagcttttccccccaaactcagagaattggatcaaattggactttagaaattttcattttcaattccgtttacaatcagtaataaaattaagcattttagattgactttttctttgatttgtttatatacactgtgaacgaaataataaaacaaagttgtataggaagaaagttgcaaaaaaaaaaaaaatcctgtcggttcagagttcatttagataaaggccctttgagtcatgttccttactttctggagaggagaactaatttttactccagtagatggttcatatatcaatttaaagagggaaaagtaacacagaaacacatttccaaaagcatgggtgctgaaaagacttagactaattttctctcaagagcactaatgtgttaatctagccaaacacagtcatagtgtaagatcaagaagtatgatctatggtgtcacatttttaaaagtacacatagcattgaagagaaatcttacctgtttcaaagcaagtcctctacattcagccttccatataatttcctgttggctgtgacttcttcatactgcatcttaaatagattatctgtactctgccaatgatctgtctattgacatgaattatgttccattctgacttgtatatatacaagctgcaatttgaaatcacttttagtctaatttatttagctgaatatatatatttatttagacagagttttgctctcttgcccaggctggagtgcagtggcgccatcttggctcactgcaatctccacatcctgggttcaagcgattctcctgcttcagcctcctgagtagctgggataacaggcatgccaccacacctggctgatttttgtatttttagtacagaccgggtttcactaatctataaaccaaatctataattccactaatctataaaccaaatccccaagccagcaccacactgtctttattattgtaatttggtagtaagttttaaattggaaactgtgagtttcacaacttttttgccccaacattttgactattttgtgtcatttgcattctatatgaattttaggattagcttcttttttttatccctccccttcctccccccacaccccgaaggccctagtgtgtgatcttcccctccctgtgcccatatattatcattgttcaactcctacttatgagtgagaacatgcggtgtttggttacctgttcctgtgttagtttgctgagaatgatcgtttccaggattagctttctaattctgcaagaatagccactggtgttgtattgaagctgtatatcaatttgaggagtattgctgttttaacactgtaactcttacaatccataaacactgaatattctttcatttctttgggtctttaaaaatttcttttagcaacattttgcagtttttagagtacaagtcttacacttttgtgtgtatgtgtgtgtaatttattcctaaatattttcttttttatatcattgtaagtaaaaatttttattaattttattttcagattgtttattgctagtgtttttttatattgaagttgtatcttgccatcttgctgaactcatttattaatttgatctttttgtgtgaattccttagaattcctaaatatcagattatgtcatctgagaataggtgttaccaaaacagattatgtcatctgagaataggtgttaccaaaacagattatgtcatctgagaataggtgttaccaacacaggggttcgggctaggtcctgcatcttgcagcacagaaagccaattactgagatgatgattattgccaaggaagaaggctttaatcaggtgctacagtcgaggagatgggagttcagtctcaaaccatctgcctgatagactaaaaattaggagtttgtatagcagggaagaaatgtaactatatatgagaaaacagaaacttagttggggggaggtaaagaagtaatcctgataaatgaggggcctggagtctcattgtctggttgctataatccggtgagtttcagttcttttctactttttgggaggcctgaagatatttttctgaggcaggaactcagataaaacaaatgtaagtttcaagctttaagaccaacagggtcaatttctatgtttatccaaagacgtgtctgtgagagtgttgggttggtttcaaagggatggctttgtttcttccttctaatttcggtacctttgatttaattttctagactattttatctggccagaaccaccaatacagtgtagaatagaagtgggctaaacagatatttatgtgttgttcctaatcttcaaagaatgcatttcatttttcaccattaattattgtgttaactatgagttgttcattgttggcctttgttagggtgaggcaatttgcctctattcttagtttgttgactatacttatcatgaaagggtgccagattttgccaaaatttttttcaatctattgagatggtcttgaggaatttttttcttaattctattgatataatatactatattcattgattttcatattctaaactaatcttgcatacttgataaatcttatttggtcctggtgtataaatttttgtatatatttttggatgatgcagtctgctagtatttttgttgaggatttttacatacatattaataagaaatattgatttatagttttttctgtgatgccttcacatacttttggtatgaaggtatataggactcagacatgaactgggaagtgttcccttctattctatattttggaagtgtttgcgaaggattactgttaattctttaaacatttggtagaattcaccagtgaatctactttggcttgaagtttctgttgtggaaattttttttttattactaatccaatctctttatgtgttttacatatatgctaattttacctttcttcttgaggcagttttgttatttgtgtcttcctaggaatttgcccattttccccagtttatctcacttgtaggcatagaattgtttatattattcctttgtaagcttttttatttgtaattaaaatcctggtagtaatatctagtaatattgctgttaatttctccttttcaaccgtaagtaattagagtattctttctttttctctttgtcaaagtagtgtgttggatagtggccttgaaaaatatatgcccacccagaacctgtgactgtgaagcatttgataaaagagtgtttgcagatataattaaaggattatgaatgagattatcctgtgttatcaaggtacatcctaaatctaatgacaagtgtcattataagagaaaggcagagggtgatttgaaacagacaaaagagaagacttagacaagggtagaagggaaggccatgttaacctgaagcagagattagagttattcatcaacaagccatggaatgcctggggctaccagaagctgaaacaaacaaggaggtatttgtttgtgtacccattaaccaacctctctttattcctctctttgccctatccttccgagcctctgatgaccaccaatctactcctaactacatgaagtgaatatttttagcattatatatgagtgagaacatgtgctatttgtctttatgtgcctggcctattttatttaccataatgtctatttccatccaagtggctgcaaataacaggatttcgttatttttatggctaaataatattccattgtgtgtgtatatatatgaatatatatatatatatatatatatatatatatatatgtcatattttctttatccattcatctgttggtgtacatttaggttgattctatattttggctattgtgaatagtgccgcaatgaacacaggagttcaggtatctctttgatatactgatttcctttattttggttttagaaccattagtgagatttctggatcatactgttgttccattattagttttttgagaaatgtgcatactgttttccatactgtctctattaatttacctccccatcagcagtgttcaagtgttgcccttctcttcatcctcaccaacatttattattttctgtctttttgataatagtcattttaagtggagtgagatgatatttcattgtgatttttgttgttgttgttttgaaacagagcccctctctttcatccaggctggagtgcaatggcgcaatctaggcttactgcaacctctccctcccaggttcaagcaattctcatgtctcagcctcccaaatagctgaggcatgctgcaagcgtgcaccaacatgctggctaatttttgtattttttgtagaaatgaggttttgtcatgttggccaggctggtcttgaagtcctgacctcaagtgatctgcctgcctcagcctaccaaagtgctgggattacaggcaagagccgcctcaaactgccatcattgtgattttgatttgcaattctttgatgataagtgaggttgagtattattttcatatacttgttagctatttgtatgtcttcttttgagaaatttctagtcagatcttttgctcattttaaaatcggagtttttttattgagttgagttccttatttattctggttatttatcttttgtcagatggatatttgcaaatgttttctcccattctgtaagtcgtaatttaattttattgattatttcctttgcagtaaagaagcttttttatttgatccaataacatgtaatttttttgtttgtttctttttgcttttgttatctgtgcttttgaggtcttactaaaaaaatctttgccaagatcaaacttgtccaacccgcagcctatgggccacatgcagctcaggatggctttgaatatggcccagtacaaatttgtaaactttcttaaaacattatgaaatttattggcaatttttgtttagctcatcagctatcttaagtgttagtgtattcaatgtgtggcccaaggtaattcttccaatgtggcctagccaaaagattgtatacctctggattagatcaatgtcctgaaacatttattcagtgttttcttctagtagtttcagagttttaggtcttacatgtaaggtcttacacttaagtctttaatccattatatttgatttttgtatatggtgagagaatgggtctagtttctttcttctgcacatggttatccaattttcccatcaccacttattgaagagactgtactttacctaatgtgtgttcttggtgcctttgtcaaaaatgagttggctataaatgcatggagttatttctgggttctctattctgttcccttggccagtgtgtttgtttttatgccagtactatgttgttttgattactgtcaggttccaacctgagctggggtctgaggggacaggtggcaggtggctaaaagaacactcaagggaccataggcagttgggaaatggtgttattctcttcccctcctatagagtcagctgtgcagttatatttctcacagacaacagtggctcaaagccagatacgagctcacacaaacaggttacattaaatggctacaaatgtgattacatagtgcgcggaattgtgcgcctgcactacaaacccactgtgtcatgctgtaccagatgtctgcctcagccttctcctgaccaaagcacagccactttccttacgctccaccctctaggctaagggagttctcctagcagggagacatgcccacagggcagaaacctggacacagaggccacagcagcaatacagggagcaacaactcactactagtattcctgctatgctgcccatgattattagggtccagcataggccagagcccagagacacccaccatgtctatggggggtcatcagtaaggctgtcagctgccttgatttcctgggaaactccttgcaaagctgctatgttttgttgattgtcagggatgaaggtacaacattgcattcccaaaacagcacagatgccaccttgggcagcaatcaatatgtaggcctatcaggttctgcactaccactttcctggtttgatcaacatcatctgtcaacagaaggaggacaacttgggtgtaattcaagtctcaagtgttatgctctggaagggccataacttgcatttctacagttacgacacctgctccagggatggttaatgctaagaggtagagccaccagggggctcatcacacttgcaaaaaccaggaacgtagcaccttccagttatgtgggcatctaaggaatgtggaaataactgtggcaagcacataaggccacccccaggtagagcggccaatcctgtttgctggcaaatatgaccatactgtgtctccacagtcccataaactcccagggggcacaaagtcctctggggcccagccttgatgtggtcacctattccatcacacctttggtgtggtgataacatattatatgtgttcagactatggcagacaaccaccccacggtgacattaccccagtgttgctctacacatcatgatacctgtgttaggggcaccttgtgttctcccactaacgagccccatccatcacagacattacaggtcagccaggaagcaagcatgccatgggttttgtggcatcccctatccaaagctgcccatgttgcattctaaacgtcagccatggaactcctagtgtccatccatgtccagttttccacagaagctggatgtatgtgccagggcaagacatcccctgctgctgcttgaagggtggtgcagatccaacggttggacacattggtcaactcatcgtaggtgtgggaccattccacaatgctgttggagcatgtcaacctatggtctaaatgacaaagtaggcacaggtactaacaggggtaaatcatgcccttcaggcaaaatacaggccaagctttcatctctagataacaatgcaactgcaaaggacttctgccctgggtgatggtaccacaacttttcagcaccccatggttcctttgggtctatatcttgccagagttactggggagctcataataggccacacaggaaatacagatgttccctggagacttccttccctggccattcccctatgaatggtcaatcatagaggccatatattaagtacccaatgagtgacatgtaaatcatactataggctctccctgcaagggactatgatagccaaccatacgtcatggtggacttggagggtctgtggccaaagccaggttttttgttcccctgcctttacagacattggggcaggcaacaacagattaccattgtccccatacctggttggaggaagtcatctttggtgtgcatctgtaagtggatggggtcagtggcacagtgtagcagtgcctctactggggcctggctgccttttcatggccgctcattcaagctttggagcaccaggtccaaccttgaactctagccccacaaagaggtggagtaacatgcaaatgtaacttatttttcaggagtcccttatatcactcaataataccagtagtttgtgggttatatggaacctccactttatgtccatccattgtgcccactgttgtacgtgctatccaggaaaatgtgttcccctatcacattcaacagtcaggggatgactgtatagggcacacaagtgttgcagggcctgaattgtatgttgttggttggccatcctgcaagggtaggcaaacagcagactggtggccgtgtctacagctgtcagcacatgcatatgcccctgcaacctcagcagtgacctgatgtagtctatttgccatctagtcaagagcatccaccctactgtcacttgttgtgtaacattgggcagctgtctctgtctggggtatgtctgtgtccacgctgggcatttctggcagacctcccagatatcttacatagacaaagatagaccatagcacttattgacctattccattagtttactcccgacgtggcccaatttctgctgcagccatagagctacatctcgtgtaggtgctgactccaaccaccggacctggccaaggcatttgcctcatcattgcccagggcagtgaaaggcacatgtcctgacacatgataaatagttacaacctttcgatggcccatttcccataggtctggccacatggcctggccccaaatgggcctgtgaccaactagctaattctgtaactttcaggtagttaaccacaaggttagggcttaataaactgcccagctaccagtgaagattaccataggtgtctcctccttagtgatcaccatccacagtgccctgagttcaacctattgactactttgtccaggtattaaaccatatggtatcagtactaggctggaccatgacagcagtccaggcagcagtagcaccctggctggacccatcctgtctaccatgcctcatcaggaatgggaggtgcctctcttgaaatggtaatggctcagtgtttaggggcgcctcaggctgacccatggccttatcttgcatcaggactacaggtcccaagacttcttataattctgctgataaggggcttgtactcagggtactctgctgttctaagtaggagccccactttgctaaggtggatatctctgccatcccagtctggggttcattacccatgaacatacttgctccccaactattgggtaagttgtccacacaatgactgtagcccttcctgtcacactctcacaagcctgaagggtggcatatacagttgttaattccttctctatccatgaatagcagagctcacctccattccaaagttgggaccaaaagcctacttgtgttctacagtgctctctgcactgccataggccccagccaaaaccttctgtggtcacatgcacatcaagttcaaatgggtgccccaggtcaattacttgtagcacctgcacttgctgtatggcccatttggctgccagaaaagccatctcagcctcattgtcccaatcccaagtaattcctgtttttgtcaactgatacaatggttttgttttctgagccaaatggagcacaaatgctttccaatatcccaagaggctcacaaaagtctctagttgcctcattattgtggtctggggatatgcctgaattttattaatgatggcctctggtatggcgttcgtcttacccaaccagataactcccaaaactttggcagacaatccaggcctttggaccttgttttcattcacagccaaactgcatgctgccaaatgttgctgtaggaggggtgccgctatttctaaatctgcaagagaatcagaggttaacataatatcatccatataatggaaaaggtggaccccctttatgacatatggtgggtttatgcacacagccctgcagcaacaccgtgaaagtctattgtcgccctttccatgtgaagacaaactgttcctggctctctggtgtgatgtcaattgggaagaatgtatgggccaagtccatcacacagtggtactgtcccaattccatcatcaagtgatccatcaaatccgtgatagacagcacagctgcatgtgaagggggtgttactttatttagttctcgaacatccaccatcatcttccaagttccgtcaggctttctgactggccataccagagaattgtagggtttgtgcattccatgcactatctgcacctcctctaacatcttactagtctcagttatcgccatatggccacctggaaagtggtattgatgggtggaagtaacctgtcggggttgtggcaggacctggggccagtgatacgtatgtccacccgataatggctcaaccacatgtatttggagtctgaattctctgaccgtggcttgtaaaaccaagctgtgaaaaatatctaccctggaatgtattcaagtatggaggagatatacacagtttataagcatgcagccaagtgcctgaggccaaggtgcaaagatgcaggcttcactcccactgactggcctctgtctatgtatgcaaccttgcctggaaacttatccgggttcccatagatgaggctacaatctgtgccaatgtctaccagcagcagcacctgctgtacattggtgggagaccagtggactgccaattccacatgtggcctcctgttgtctggtgtccccccaagctgggcaccttgaccagtttcctaatcaaacacaaaacgctctataccttcacccatctgcaagtagtccttgagctggagcatctgggtgggacatggtcaagcagcatcatcccgcccgctgttgggcattttctggaattggtgattcagggacaattgcctccacaaagttaacagcacttcattgggttgcctctcagttttctctcggtcaaccccagccaaaatcaaaccaatccacatatgtgtatgagtcaccactggggcccttttgtcccatgagatggccccctgcagaaggagtaccttccccctttttatggcatagactcctctgcttccccgagggctgccatggcagtagtcacctcatgtatgcagcaccctgcacacagattgacagtggccagggagccaaaggcactcaggggtgcagagcacaacacaaggtccctcatgtgggaggtaaggtgttcatcatctggccctcgggtattcggatcaaacatagcctgctgcatacccatctcctgaattacctgcaccacatctgtttatgactgccatttactcacagtttctggtatttctctggcatagtcccacaccatttgcatggcctccatcagccattcaattatggtgtggttgccttgcccctgtgctaaccacttgctcacctgcaattgctgatggagggagggatgagtcataatggaggccaacttttccatctcagaggaggagcagacaatactgttggctccctcatcccaaaggcgaagcatctaggtgggtaggatttcccccaagcgctgccagcactgtttactttattcccacaactccgttggggtataggcagtgtatgacttgtgctccatcatggtaggaggtctctgagcccacccctggggcctcaatgacttcctggtgtattttctgatgagccactgggggagcccacaacagaggttcttcctcctcggtgtcagatcgggcaggggtctctgactggggtggcaggcccaagcctacactaatagcagcctctaattctcactccaacctgtgtacgtcggccttcaggctctctgcttgtgcctggaggtcccttacctgtgctgcatcctgcagggactgagcatgcacttcccatagcacagtcaaaaatgcccatccaattctgctgggaaaggcacactccttctcagtgctctgtgcttccaggtgcttcagtgccttatccatgcacacaggggacctgtccaccaccacccatgtctccaccagggcccatcttagcagcatggctgtcactgggtaccataacccatattggggccacacggctgacctaggatcatcaggggccaagggctcactcacctcggaatcctgctgactacaccaattgtcaagttccagttcccagactaagctggggtctgaggggagctggtgaacaggtggcaggcagctgaaaaacactcaagggaccacaggcagttgggacatggctttattctctccccctcctacagagtcagcagtgcagttatatttctcatagacaacagtagttcaaggccagatatgaactcaaacaggttacattaaatggctacataaatgtgattatatagtgcatgggattgtgtgcctgcactccaaacctgctgtgtcgtgctgtactggatgtctgccttggcctactcatgactaaagcacagccatattcattacaattactagggctttgtagtatactttgaggtcaggtagtgtgatgtttccagctttgccaattgtgctcatggttgctttggctattcagtattgtttgtggtcccatgtacattttagggttgctttttctatttctgtgaagaatgtaattggtattttgatagggactgcattccatccttgatcattttagatattttcatcattttaacaatattaattcttgcaatccacagatatgggatatctttccattttagggggtttgttcttcaatttcttttgtcagtataattttatttgtagagatccttcacttttttgtttatatttattcccaggtattttttttttcttgtagctattgtaaatggggttgctttcttgatttctttttcagattgtttgctgttggtgtacataaatgctactgagttttgtatttaatttttgtataataaaactgtactaattttgtttatcagctgtactagttttggggtggtctttaggtttttcttttttctttgtttttgagagggagtctcgctctgtcacccagcctggagtgcagtggcctgatctcggctcactgcaagctccacctcccgggttcacaccattctcctgcctcagcctcctgagtagctgggaccacaggtgcccatcaccatgcccagctaatttttgtattttttttagtagagacagggtttcaccatgttagccaggaaggtcttgatctcctgacctcgtgatccaccctcctcagcctcccaaagtgctgggattacaggcatgtgccactgcacccagccaggtttttcttaatataagattgtgccatctgtgaacaggagtattttgatttcttcattcccagtttggatgatctttatttctttctcaaacctaattgctctggctagtacttacctagtagtatgttgaataaaagtagtgaaagcggttaaccttgttgttccagatctcaaaggaaagggtttcaatttttctccatttagtatgacaatagctatgggtttgtcacgtaaggctttattgttttgaagtatgttccttctataccaagattgttgagagcttttatcctgaaagggtgtattatatcaaatacttttttagcatctatggaaataaacatttttttaaaaattctgttaatatgatgtatcacatttacagatttaaatatgttgaaccatctttgcatcactgggatgaatctcatttgatcatgatgaatgatctttttaatatgttattgaattatgtttgctagtattttgttgagaattttgcattttattcattatgaatattgacctgcactttccttttttgtgttgtccttgcatggatttggtatcagcataattctggcctcataaaatgagtttggaagtatttcatcctcttaaatattttttgaagagtttgagtagaattgttattggttcttctttaaaaatttggtagagttcagcagttctcattaagtcctgggtttttatatgggaggctttttattactgcttcaactgccttattcaatattggtctgttcagatgttctatttcctcatatttcaatcttggtaagttgtatgtacctatgaattttttctttgaatttttttgttgaaggttttctgatttgttggaatatagttgttataatatgctataatcatcctttgtattttgtgatgtcattaaatacaaagctgtaatgtctcctttttcattttttattttatttatttaggtcttcttttttttcttccttagtctacctaaagctttgtcaattttgattatctgtttttaaaaatcaacttttcattttgttgatcttttgtatgtttttagtctcgatttcatttatttattctctgaactttatgatttcttgcctcatactaattttgggtttggtttattcttgcctttccagtttctctacatgtatcattaggcagcttatttgaagctttaccacttttttttatgtagatgttcattgctataaattttccctttagtactgcttttgctgtatcccataggttttggtatgttgtttttacattttctcttgtttcttttttttttcaaattgtcctaactttttcattggcccattggttatttaagagcatgttgcttaattttcatatattcgtagagtttccaaggtttttcttattattgatttatgattttttccattgtggtcggaaaagatatttaatacttgactgttttaaatttgttgagacattgagacatgttttgtggcctaatatattatctaccctacaaagtattccatgtactgatgggaagaatgtgtattatgcagccgttggataaaatcttctttaaaagtcatttaggtccatttgctctataattttgtttaactccaatatttgttcattaattttctgtctggatgatctgtccattactggtagggggttattgatgtcttgtactattattttattgtggtgtatatgtccatttagatctactaatatttgtttaaatatgaggcactgttgtgttgattacctatatatttacaattgttatatcctcttgctgaattgacccttttataattacatagtgatcttctttgtgtctttttacagttttttacttgaagtctatttttatctgatataagtatagctattcctgctttttgtttgtttgtctccatttacttggaaacttttgccatttattcacttttatcctatttgtgtctttataggtgaagtgagtttcttgttagaagtatatagttatataattggatcttttaaaaaatatattcatctaccctctatcttttaattggagaattttccatttacattcaatgttactttttataggtaaggacttactactgccatttggttatttgttttctgatgttttgtaactcctcttggcatttcttccttcttaccatcttccgtttgggtttagtaatttttctctggtagtatgttttgattccttgctttttattttgtgtgtctcttataccatgaagcttataaaaaatcttatagctatataaagctcttttaaacaaacaacaattaactttgataacaaagaaaagatacagaaacaaagaaaactataaaacgatctttgaacttcatccccccagcatattgacctttttgttgtctcagtttggatctttttatatctcttaacaagttctcatagttattatttttaaaaatttgtgttttagtcttcatactatagatatgagtggttttcacattgcaatgacagtgttagagtattctgaatttgtctgtgtacttacttttatctgtgagtctatacattaagatgttgtttaactgcatattagtgtctttttcttttaaactgaaaaattcattttattatttcttttaagaaagggtctggtcttggtgaatttcctcagcttccgttttctgggaaaagctcctcattccttcaggtttgaaggatacttttactgagtatagtatgttttgtttagcaagttttttacttcagtactttttatatatcctttttttaacttcagtactttttatatatcattccattccacctggcctggttttcactgagaatcactgagatttcactgagaaatctgttttcagattgatcagagctcctttttatattatttggttattttctctttccactttaggattctctctttgccttgatatttcactgtttgactattatatgacctgggatagtatcatttgggttgtatttacttagtgatacttgacctttctgtacctggatatatctatttttctctgggtttgcaaagttttctttatttctgtgaatactctttcttctccttgctttctctcaaccccctcttgaaggaaaatgactcttacatttgctctttaaaggctattctctagatctcataggcgttctttgtttctttccattatttttctcctgtgactctattttcaagtagcttgtcttttagttcactgattctttcctctggttgatcagtcctgctgctgagactctctgatgcatttttcatctaattcaatgtattctttagttccaggatttctgtttgatatttttaatgactttaatctatttgttgaatttctgtaataaatttctgaattgcttttctgtgttttctgggagctcatcaaagagttttgttttttttttcttccagtaactcaactcataccatctcattagggtcaatcactagtttctttctttgtacatttgaggtggccacggttgtgttgtttcttatatatgtacatctatattcttgcattgaataattggttatttattgtagtctttgccttctggcttggttagatcttcctggattatatctgcttagaggtgtactgtatagtttacttgttgaattctcttaactttagattgtggccttcttattagcattacatgtcacctcaatcctaggtttgccagggctcttgcaaaagcttggggtgctgcttttctttaatgggatgggtttcccaaatggaatatcccagctatgtgaaaaggctgtctatgggttcatgccaagaggatccatggagtatgcctctcattgtatggtgctgctgaactgcctttctgttttagtatttctgtagagacagcctctaaatttttcacactatggttgcaagcccctctttgattcttggttctagctgtactctactttctttttttcctcctacaggctttcaaaatgcttcccaacacatcttgcattaagacaagaattaacttactgcagaggaatccaagataatagagaagctggctgcctactctgatctcatttttccagtgagacacatatgtgtgaggggaacttttctgcatagtgcttggcatcatgcatacagaaatgtgtttatcttagtgtctgttcacaatttatcatttgtttgtggccctatggattttcacagcctaagttttgagttttgggatattactggtgatagtcttggtgccaaacagttgtttcagttttaattttgtgaaggagagtgatgccaaattgttgctgctccatcattttggtgatatcacccacttttgttgctcttcctattaataaggaatcttaagagcacgctagaatattgaggaacaaagacaatgttaactgctaggcaatatagatttattggatgcccaataactaaataccttgaccccaatgggaatttgtagttcttattgtcagaaaaccactggtcctatggaaaactaagtatgagctgattccctccaaatcatgaggtgtgaggtgggggcaatcgtagctggctcattgtccaagaaatccagagtgaaatcctatgatcacttttagacaattctgtttattgacatatcattaatcattatagattcctatctcaatatgtcagtaaaattgctgtactgggactatataaactattattcaaatgtaagtatataatatactaatgacagcttgaatcaccttctacgatagctgaagtagatcatcataatcttaacaccacattttttttctatgcattgatctatacatgacaactctcatttccactgcaatttcaacatgagagaaaaagtaatgagacagagtagctgtgttctggttagaggcgcagacaaagcagtttcaagagactctttactatcatgggtagcaattaaatgtgcaatggtcaatatggtcagtaatgggggaaaaaagcacatggtgccagattgagccaaccattgtgtacaaccattgtaagaaagagaaatttatctatgtttttctgattcatgcattggtacacacatttacagaccagaatataactctagaaattggcagctattttaatgcttccaatggtctgtttttgttaaatgaaaaaggtaatgcaagaatctattttagttatttaaaataaattttcctcatatggaagttgaatgttttacagcaggatggtctgggaatgggcattttgcggcagtattgaattttcatatgttatagttatgtagcaagtgagttcatcatgtcaggagggagtataagttcatctccttattagtctatgtctgtaatctatacgactattaaagctaatatttctcttgactctgcaactaacccctgaagagaaaaagtcatctggccaaatcccaaaacactcctgaatgcattagggtagattatgaacatgtagatgaaatacaaggtttatgaatctcccctctgttgcctgaaccccctttcccttgccacgcttctttgcttttctgacagtattttattggctataaatgaaattcaaacagtgccccaaaacgaaactccttcgcaaaatctttcttgcagtgaaaataactgtatgcacagtaatttaatcctcttcttcaaaaattgatacatattacagtagtcctcccttatccacggtttcattctcagagttttagttacccatggccaactgcagttcaaatatattaaatggaaaattccagtaaaaacaattcataagttttaaatcctatgctgctctaagcacggtgatgaactctggtgtcatcttgctctgtcccatacagaccataaatcatccctttgttcagtgtatccacactgtacaggccacctgcctgttttcacttggtaagcatcttggttatcagatcaaaggaacgtagtatatatagggttctctactatccatggtttcagatccactgggggtcttggtatgtatcccccacagataacagttgactactgcattaaaattaatccactattaggtaataaaaacttggtgaagaggatcatgagatttaattgtcaggagactcccctgaagaagtgacatttcagctgaaacttgaatgacacttaggtattgatgttggagaagagtaatctagcacaataaaatataaagtgggaaggtggaggtaagtttagcatcagaaaatgtctgatgtggcttgaatgtggaatggacagtgaatgggataagaaggttgacatagcacagatcatggagagactcagggacttgtttggatttaattctgaaagtaactggaagccatcgggagatataggcagttgagtgatataatttaatttgtattttaaaagatcactttggcaggtttgtaaagaaaggattgtctgatgggcattaatggaagcagagaccactccaggaactctggaattagttcaattgatagcacaaaacaacagagaggtggttagcagccatgcagatggagagaactggcctgagttaggatattttggagacatacaaaatgattttgatactatttagcagctgcataatagcccattatatgaatgcgccatgacttatttaaacattggaagaggcgctttcaaatttaagcaatcaagtgtattctgagatctactattaagattcctgcttcccaaattgtcttcatttacatttacccagtaactatctatttaaaacgcataaggtggtaccctggctgtactaaagaataataaatagttccattcacccttgctttttaaactatgacccatttcagttcagttttaatttttgagtaagaattagtataatatatgaaaagcattctgtatgcagttccaatatatattcaagttaccatagaattgaacgttatcatttcatgggatttttgtttttagttttgagtagaacaggcttgaaaaaaatataagaatacctgtaggaatcagatgatatttgataattgaacagctctttggttttaattcaaaattaaactccgaagaataagaataacttaaataaaccaataaagtttggctatgcaattcagagctcaacttaaaaagttacgcatccagtaaatttttcagtaggctgttcatttttatgctaattattaagtttcattctattcattaaaatgttaaactttatcctgagtcacctaaatcttccatgagctctgcatgtagaaaataatttggcagatgcttatttggaggaaattgcttacttcttaatacaacttttttttgagagaggaaaatattagcaaaaaatttttatgtccctaaaaattcaaacattttgatcatgagtaggagcataaacagagtgtatcatatacagttggaataaaaccttagatgcatgcaactcaaatggaatgaatgattccaactcatatgcttgttaggattcaatcaactctcagtcattcactgagttgagttacaagtagaagagagtgggtaatgttaaagacacactgcacaattcttgtttataatatggctttaaaatctagttgggaagacaagaccacatgttggtgcttttgtgatttttgcatgctgttccttctgcatggaatgactttctttaacttcgtggccacacagttgctaattatctttcaatctgtcagtatcacatctgtgaaggttttctttctacattaaacagtttataataatcgttgttatgcttttttggattcacatgtctgcatctctaaacgagcgtgtgttccttcaggaaaatgactatgtcatgtccggagtgcttggtgtaatgtcttatacagtgttggaccatcattaatattgagtattgataatataaggcagtttgctgtgaattctaaatgtctagatctatcgagaagtgtttagggaaatttgtatctctcaagagaacaagatcaccagggcctctaatcctggtattagaattacaatcagggcaaatcctgaaccatttgaggcttgagaagagggaacagatgagggaggaaggatgggttggggaagtcttcaagagtttttcaactctactaatctttggttctacatttcaaagtttgaattttaaaatagctctattacctatataaccattactttgtggtctaaaagtaaaaccataaaatcagcttagcacaacagaatgtactggactgaggcattcacattcagtcaatttttcacagtataactcagaaagaggttaaaaagttctctttgctttttgagaacccattttgtagttcattgttgcagattgtctgatgttgactttcagaagtgaactgaaatgtatgagaaatctggaaatatggtaaagacaaggaatcaaagccaagaagcaaacagacacgcaggggaggatatttaccgcatcgtctcactgagcatacctggaaaactgagaagctggcttttgaatagtgcatatataatcagttctttggtctgtaaattcagtaatcatgaaaccccatgaattagtatcaacatagcagtacatgtcttcattaatattttgtatcattacctctgtagcctctctgaggaattcagggaattttatgggggaaaaaaaaccttaaaacttgaagcaactaaaatttatataaaaatcatacagaatgaatgaataaagtatattaaatatacaagctcttttcttagagacttagaatataaaatgaatacgaacccactttccccaataattagccttgatacacaagtaagcataagcacaatattttttcttgccaatttctacaatgacccaaaacctttaatgaataaaaaagatatatcctaactaattaaataattatagttgacaataactttattaggcaaaaaaatctactaattttcattgtctttttaaatattacagtattcgggcattgttatatatacattataaaatatatatctagatatctagatatattcatatatatatatatatatatatatcttgagataatatgaatgtaacatttcaaattaagatatacacctctgaagagaaaaatgacactcatcaccatggggaaagatagtaatagtagttaatcaacaaatgtgtgctgaattaaattgaatgaatgcaggatcctctaagtggttggtgaaactgttctggactctaagttcatttcctaagctagatactctatagatgacatatactgaacaatttctataatgcaactgcttcttcctaggtcgtctttttacagaatggaggaaatggccttttaattccacaatccactctggtagctataattatattgtttctttttataatgaagtagaaagatatagtacattacaaaaagaataaatttataatctaacaaactatgaactcttaagcaaccaactcttaactggtggaatctggaaagcgcttcttaaataaaaaagaaattctatcctggatgtctccagaaatgagttgtgttactctagcgccctcctacattaatgtaaaaagtagacaatgctgagctccgcagtttttgtgcagtttccagctttcaaagtaccagatagaactctgactccaacactttccatccttatattccccaaaatgtatatggcattttaattatccttcaaaaatcttgacttttctgacccttcatctcttcttagtagaggaacaagagttcaggaacaagtgtggagatgggggtggggtcaaagggaaagaaatgcaaaccagactcttacccaatgattacttcttaaataatatggtctgtaacagaggttgccaagcctttcctatatagaaccaaagagtaaatattttaagctctttaggatataaagtctctgtcacaactactcaactctgctaatgtatcataagagcagacacacacaatacataaatgaatgaatgtggctgtgtttccataaaactttacttactaaacaggtggtagtctgaatttggtctgcaggatatagtttgctgaccatggtttatagcataatctttgagtatagcatacaaaatatcattcagccgatttttttgtaccagaaatttccaaaatcaactgaataatttacttttttttcccttaaattactctacagtaatctctgtggaagaaggtgaactgcatttacaattgcttgaaatagtgagaaaagttacaaaaagaaactacaaatacaaaacaggcaatatctgataaaataaatacactctgtcactatgttaaacaccagaatttttgtatttctatagagaacaccccaactatcagacctttttgaagcattattcgcatttacattcaacaaatatttaacctaatccttataatcatccaccatttttcaaactttggaaatccagatttagaaagataaagcagacctcttaaataggaagtggcaaatctaagatctgaaccttgatcatctgcttccaaatcctgggctggttaagaaaaatattagatttaaaaaaatctaaaatacattcaaaggctttaattccgcctagtgtttttcagtgccagataattttgtaacaggcaattctcagtaattgtaaaacacacaaatgatgactttcactgtttttagtaataagagtaaatcaatgcaattctcagtcattttgcttaatggagcacattgaaaaacaaaagagctatactccctgtttttttctaatattttctgatgaatttcaatagctagactctcaccatactttaaagatcgtcattcttccttaaaagcaaaaggcaatttaatgagatacttgcagtagataaagttgccgtatttgatgtttccatgttttattttctgggagatgacacagaacaatgttgtctgagattgtgaatttccatacagagggatcattgaagcacccgtcgttcataaaacactctgtcatgctggagacaaaactatcaaattttattaaaacttagttatctcaagtcaagctttacatttccaaatagaaatagtgaactgcaatgtgtcagaactctaaatttcattaccacagcaggtgtcattatttggcacataggactagggtttgtgataactacatcatacaactccaaaggaaatagcagaaatgttctttgaaagcactcttctatgtctaagataataccatttttgagcagtccagcctaagaatgaaaaaatatatatagaaatactgaggtaaaggccatgatgattttcatattacccacaattaaagtttgaaattccaggaaagcatttttagatattatagtatcaggaaaatataaggaaagaaaattagctcaagatttccaatctgactttgtgctagcaaataatgttatgcaaaataatatctattattaatatataataatatctattatgttttaaaaaataaaataatatctattataattataatcccataattttttcttatctctggtaaaatatctgctctttatgttatctcaagtcaaattatacagtttagaaatgagtgagagatacttggaatcatctttcctcattcataggcatctcaaggaagaaatcataatagaatgatatctattattttattttgtagtgtttatttttattttataaaatttttccataatttattggggtaccggtagtatttgcttacatgagtaagttctttagtggtggtttgtgggatcctggcgcacccatcacctgagcagtatatactgcaccatctgtgttgtcctttatcccttgctcccttcccacgctttcccccaagtccccaaagtccattggttcattcttatgcttttttgtcctcatagcttagatagaatagccagatataaatttagatggctaaacatttatatatcatcagtaaaatttcggtccaattctcatttctaaaaattttggtactagagagcactctacttttatgattaaaaattttaagaatcttcctttaagacaaaatatgactccttttaatttttctccctggatccaatatccccttattgtataaaagagtgtccatttccttctcatggacaacctttaaaatatttaaataaaactaattttaaccgccaccaaccctcaatcatatcatgtccaaaataacctttccaacctccttaatctatttttttttacaataaggtttattatttccttttatcagtgcagttttggatgtgcaccatttaaaaaataaggtctttctttaaaaatgctcataaagtaaatagaataatacaaatatagtgtcaggaaggcaaattgtttctaatacgtcttttgacctaaatggtgaatgcctattgttaaagcttcagattattaaagtttcaacagcaaccctgtcgaactattggctaattccgataattttcaattaaatcaccaacattatttgtttttaatttgagttattatccagccaccagtctaattgatttcatatttgtgcaactgattttctaatagaaatatagtactttgttgttttctttttctattacatttaattttccttgttcctgtgcctttattcaagttgctgataaaaactctaatctgaaaagtccgagcaaaactctgtggcacattcccagtaagctaaattccagatgggcatcaagcattaatcaatatcccagggcatactattaaacctgttaaaactctaccaaactttttgccattctgctcacaagagtatcatgcgagtttgtcaaatgcctagttgaaacatagactcactatgtcgatggcccatatgaggcccataaagaaaattcagagctcttaaaaagttgctatgaatctgtaatcccataatttttccttatctctggtaaaatatctgctctttatcttacctcaagtcgtaccagagagtttagaaatgggtgagagacatcggggatcatcattcctcattcataggagtctcagggtagaaatcataatgaccatatttcatttttttttctatgtctgtgcccttgtgtgatagtagcatagttgcttgacagcatattgaagagtcttcattactcactgccattttctttcatgtcctagaagtgaaaaaatgttgtttggttccagttgaccacgattgtatctgatcttttcttctgttttatttgtttgtttcctaacagtttatgtttctcaacataaaatactatcgtcgtcatgccagactgctctctaggatcaccttgttttctcaccacaatgccttagaagggagcagagagctcagggtgtcactagtcagcttatatctcatctcatgttatttgaacaataggactctttaggagatataagaacattataaatacaaggtgcaaaatgtatgtaattatgacacctttttaaagtaaaccatagcaaatcacatgaaatagtgctttcttgatacaatattattatcgtttcttctacaaacattatttcagttaaggagagtgtgcaagggctctcctggctacctgagcaagcatttgaaagattcattatatttcctagggttaaaaactattttcctggagtttctaaaaatgagagcctgccataaaattgtgaagtttcatgggaaaagcaaagtaacttttaaacaactgaaatttttaactattttctagaataaaaagtatagaaggtcagtggatcacagctattgttttagctgaaaaaaaaacggaataagttgatcatggttaggtagattataattttattattacttggtaaaattgaattgtttgggccctggtaatcctcggctatttgtgtgtatagattaaagctcctggttctcacttaaccaaactgaaaagcactaattgtcagagaaagaaatgaagtttttttctagtgacttgttttcgaaacaacgccacttacatattttcatgttgtcacatttacatctgagaattattggtggaaaacacaaatggcataactattaaaaatgggtttctaatcataattcaacatgactttgcatcaaatagaaataccaaattgagaaaaggaaatgagtgtttgactaaataaatgtaatgaaatggtagtaaaagagtcaaaaattattctttgcattttctgtcttttcagtttatctatctatctatctatctatctatctatctatctatctatctctctatctatcatctatctatcatcttgatgtattgattcattgattgtggtaggcatgagcttattatgtaaaataagatatgtgcttcagtgacactgtttttgccaagaggtgttgctttgaggccttccatagcagcttcctgggcatctgggcattgatgggcttgcgaatgagctgagttggcagctgcggcactactggttgtagtcttgctagtatgctttcaactgtatccccttgggatatcagctcccttacctcatcagtgcagctctcacccatgataatgtttgtcataaatgtgacacaaatccagtccccatgctgtatctgcttatgttagccaatggagccacacagtggattagaataacgcacaaggacactggaggaagttgttcataagagacaaagagagcatatacagacagtggacatgaaacatttaattgagtgaagcttttttttctgatttgaaaataaatatatgttagggtaaaaaaaccaagcctgtaaaggaaaacagaaaaattggagttaataaagggacccacagcttcactactcaaagaaaactatcgctaaaatttgggttgcatgtaactctttctaatgtgcatatatgtgtatgaacaacatatttgatgatgtgcagtactttatttaaacttttgcctggtacattaggccattcttgcattgctataggaaattcctaagatcgagtaatttataaggaaatgtttaatttgcacacagttcttcatgctttacaggaagtgtggtgctgatatctgctaggcttctagggaggactcaggaagtttacatttatggtggaaggtgaaggaagggcagatgtgtcacatggcagaagcaggagcaagagtgagagtgaggacgtgccacacacatttcaatgactagatcttgtgagaactcactgtcacaaggacagcaccaaggggatggtgctcaaccattcctgagaaatcctcccccatgatccagtgacctccctccaggccccacctccaacactgaggattacaattcaacatgagatttgagtggggatgtacattcaaactgtgtcacctactattgtctgtttcgttcattccaattgtttgatctgataaataattctatagaagacagtgtaggctgaattgttcaaacattttgccatatttcaagttaagttcccagaagttgggtttattaaaatttaaatattttaagactcattacatatatacacaaactacatgataaaagagttatgtcagtttacgttgtgaccatgatacagtggatttaaaactttttattacatttctttttctttagtagagatgaagttttactatattgcccaggctggtctcaaattcctaggctcagtcagttctcccgcctcggcctcccaaagtgctgggattacaggccaccctgcctagccatgatatgatagtcttataataaaaaatccctctcacattttttttagaaaaaaaaatccctcctcttctttacaaaatatgtaatgatttgcctttattttacttgtccaatttctaacacagtccctattaagttagaaagctccacaattggaatcacataataaataatattaactaaatggcttaaaataacacaaggaaccccaagaagagagcttagattttatgtaagtattcagtagtcacctacttgtattccactaaattgtgaactccaaaaacagtgttttttatttaaagataaatttttattcaatacctgttttgtattaggcattttctcattttttgagaatgcaaaggaaagcaagatagaggatttcagctactatgcatgagacagcaaggcaaggggaccagttgaatatcaggctcaatgtcatatgtctggaatttatctttacacagatggtatttgtaagggtatatatagaccaaaaataaggtgagcttggaaattgatgatttcacattaattttctgcatgtcacatttgaggaatggattttactttaagaataaataatctcttgacagcctatgcatcagaatccatgtaggaaatagtgaattagtcatagttcaaagttgatcatctatttatttggatgttaatattaaatcataaaaatacaatattcgacaagtggataatgttattgctgggatgcttgaacaaaatgttcaattattttaaatgttatcaaatcatttaaaattgaaatttggaagttttatttccacaggagtaaaactgaatcatttaatgtgacaatgtccaggacagagtttcttaatcaaaaccctcgttagagaaatttaactccttatattacattttacggcttttgttttaattttatctaccactatagtcaatgataaaatgtgaataaatagaaagaaaaatattgtcattttattgtcttctttctattgatataattaccagagtcttctcaaagagggcattaaaaactctcttagggcactgaaagtcctttttactcggtttgaggtttcttaaaaggagtaaatgaaaaagtagggtagtggcttagagaaatccaccctggagaagacatgaacagaaaaataattacttataaatgggacaagttgatgtaaaatttgtaaagatgggttggagagttttggcaaaaatgtgagctctggaggaagcctgttgggttcaattcctgttctgtgcactgttctttcttttatattgttagttttctcaactgcaaagcagtgtaacacagtcgctatgattgctatgaaggttaaatgaaataagacgtgaagaccatttagcatacagtccaacaaatacaattgagatttataggctcagaagttaccattagtaatattcaagcacctggaaatctcacacttaatattaagaacaaataatgaaataggcctaaagactaagatgagttataattgtattatacttagtgcaataaattagacaaaccaggaatagagagattgttttactcttcaaagccttagaaagctatggctgtcacagaagctgttgaaattagtgaggatattatatgtcagtgggtaggagaggaaatgaaataagactggccacatagtcatcaatggtgtttagagtagccacattgtttcataagaacattcttgtcaacatatgagaactggagggtgaagattaaaaaaagagagagagacagtgatatgcaggatgagctcagttacaccgaatgctgactttatcacactgcagttacagaaaaggaagaaaaggccttagttaaaatataaataatatatcaagaaagcggaagcaaggttcagtgaaataaaacacaaaaatctaagaaaagattaaagggaagtatcttgatattgtgtatttttgaaagggctgggacaaaatgcattttggtgtacactgtaaagaaagataatgctaaaatcatagactaaataaatacatatgaaagtaaatttacacagaaaattagaagtatattttttgtttgttttcttatgcattttttatatggaccagcacagtctatagcatgtggtcccacttatgagaaacttcgtgtttatttgttcaatataaatgttttcaatttttttgtatgttaacaaagaaaaaatatatgaaagtaaaaggaagaaaagaaattactcaacataaattgggagatgattttttgtctctctgtgaagcagataaaatggtcagtatataacttcagtctctgtgtccagagcaggggttcctaacatgaggtcaatactcttgagattaaaatatttggtgtatgagatgatactctagggtgataattcagagctttcatctgattctcaagaacattgatgatccctttccttaaagctcagaaacaagcgatcgggagaaagataagtaaatgtgactaatgcatacatgaggcatgccatttgtatttatggattagcttttagtggtaatggtttagaggaaagcagtgctaagctcacatgggcaggaaagcaggcagcatactgaactggctaatattaaaatgtagggccgggtgcggtggctcatgtctgtaatcccagcactttgggagtctgaggcgggcagttcacgagatcaagagattgagaccatcctggccaacatggtgaaaccccgtctctactaaaaatacaaaaactagctgggcatagtagcacgtgcctgtaatcccagctactcaggaggctgaggcaggagaatttcttgaacccaggaggcagaggttgcagtgagccgagatcgtgccactgcactctagcctggtgacagaatgagactccgtctcaaaacaacaacaacaacaacaacaacaacaacaaatcagatacaaaggcatttctctgcaaaaggggaaattcctcttgtaaaacaaaaggaaactttataatgtactaaaaaatatggcaaagtgacagataaagaaagttgtcttccaaaataagcaatggggaaaggactccctattcaataaatggtgctgggataactggctagccatatgcagaaaattgaaactagaccctttcatttccccttattaaaaaatcaactcaagatggattaaagatgtaaatgtaaaatctaatactataaaagccctggaagataacctaggagataccattctggacataggacctggcaaagatttcatgatggtgacatcaaaagcaatgacagcaaaaacaaaaatggacaaattggacctaattaaactaaagatcttttattcaggggaaaaaaaaagagcaaagtaaacagacaatctacagaatgggagaaaatagttacaaactgtgcatccaacagcagtctaatatccgtaatctataaggggcttaaacaagtttacaggcaaaaaacaacctcattaaaaagtgggcaaaagacatgaacagaattttccaaagaaggcatacacgtggccaaaaggcaaatgaaaaatgctgaacatcactaatcattaaagaaatgcaaatcaaaactacaatgagataccatctcacatcagtcagaatggctattattaaaaagtcaaaaaataacagatgctggtgaggttgtagagaaaagggaatgcttatacactgctagtgggaatgcaaattagttcagctactgtagaaagtagtttgacggtttctcaaaaatttcaaaacagaattaccgttccatccagcaattccattattgcatgtatacccaaaggaatataagtcattctaccataaaggcacacgcacacatatgtgcgtcacaccactattcacactagcaaagacatggaatcaacctaaatgcccatcagcagtggactggataaagaaaatgtggtacacattttatacaccgtggaatactgtgcattcacaaaaaggaatgatcatgtcctttggagcaacaagctagaggccattgtcctaagcgaattgacacaggaacacaaaaccaaataccacatgttctcacttgtcagtgggagctaaacattgagtacatatgagcacaaaaaagggaatgacagagactgggggctacttgaggatggagggagggaggagcataaggatttaaaaactacctatttaggactatgcttattacctgattgacaaaataatctatacaccaaacccctgcgaacaaacaatttacatatgtaacaaacctgtacatgttcccctgaacctaaaataaaagttaaaaaataaagctgtcttccaaaggaaacctatggaagttctatacaaaggcaaagcatatatgaaatatatggtcttctaaatattcatgttaagataatcagtaaatgcctggaagacatagattggcttagaatgttataaaaatgctaataatttatagcttttgttttgttttgtattgaggcggagtctcgctcagttgcccaggctggagtgcaatggcatgatcaaggctgactgcaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagccaccatgccggccctatagcttgtttaaacaacataaacttcttgagcacatgggggaaagtacgtatgaagaagcagaaagagcactatttagttactgaagtgaaaaataatgaaatatcttggaatcaacttgaacaagatagggggaggtatgttgagaaagtattggcagtttccattaaaaaaagaaaaataaaaattacaatcttggcgataaagagctggaactagggaaaaatatttttaaaatttaaagaagtaatacaatatttacaattcaaaaaagtgaatatttacaatgaggagagaaatgaaaataaattatactttgattccttcttaacatgacaacaaaatctcaagattttcaaatgagaaaataggtaatttaggctttttttgcatggttcttcagaatttatgattgtagtattctacagaatatgctctcaaaatacagggatttcaataaattccatattgcatgattattataaaaatatggaaaagtgtgttgatgggggatgctaaagttctctgcttataattttatgcagcttattattagatttatccacagactagcttcaggctctgaacatttctaacttttttttctttccttcccactttcttctgaaacttggagtgttattgtataggacacaattttatgtgatatgactctcagaatatgacatctagcctcacaaccttatgtcacaacatggggtctgttggcacaacattctgtaagcgtatatttggaactcatttctatatcaaaatagctaacaatagcttaattctatatggaagtaactgcaaacaatttaacttcctcttactaaccgaaactaaatgtacccccacttaacattttgttactcagactctagaaatattatcagacactccaccaccacttgacacaaggaaaaggtcatagagggaattaagagcagaattggccaggcgtggtggatcaggcctgtaatcccagcactttgggaggccgaggcgggcggatcacaaggtcaggagttcgagaccagcctgaccaatgtgctgaaaccccatctctactaaaaaataaaaataaataaaaataaaaataaattagacaagtatggtggtgtgtgcctgtaatcccagctactcaggaggctgagggaggagaattgcttgaacccgggaggcagaggttgcagtgagcagagatcgcaccactgcactccagcttaggcgactgagggagagggagaccctgtctcaaaaaaaaaaaaaaaaaaaaaaaaaaaagctgaatcatacagccctctgaatcagttgcacttttctagaaattttgcaaaaattttatgaaaaacaaatgaccaagtgaacacctagtttcatacccaggactttaaaggtggtctatgcaagtgggaaatttgaagctcaaacattgtatatgcccacataaatctacctataggctaatgtctatttgtggataagggaatttagaaagactatccaaaaagttaaccatattatagaaaagatgaagataaagcaaccaagggaaaaacactggaaatataaacattatgagatgtaaagaaactttattttaacattagtcaatatgtccacttgtgtattgctgaagggagaactagagtcttaaagaaaaagtgattgttcctgatagaacaataatttattgcaaagtacacagtcttataaacactaccctttgctggaacatgataagatttgtgttcatggttcttcatattcactcttgctccagagtcaatcttgaaataaaaataagataattccagttcattttcagagtcctctcagtccatctgtgtcatttccctgtccctgaccccatctctggatcccattgctgttatgattccaagtggatgggagaccatcttcttggctttatgttgggcaagtttgcatgtaatattcagttttgtttgctctctctctactctgtttcaacccaagattgcaagctgtatttcttaacaattatttattaattatagataaaatactagatgttattggcaataacataagagtaacataaatattaaagttaagttagaaaagcattgaattaaaaatagtctatgtaaaattccaatcttgttaggaaaatcaggcctaaaacaaagttctacaaatgagtcctctgtcattttagatggtataagttaatttataatggaagtttgcattttatcagaggataatcaaatgactgacttgctgcatttgaaagccttctgatactaaaacagtctgtataggagaaaaatgggggaaagaaggacttcctggtgagagtaaaaatatagaattcaagcctacaaataaaattgaacttgatttttttctgtggatactttctcgtattctgggttaattttctttataatattttgaaaggaagtaaaatatgcagagtgccaaagacagcaacagaaacctcccatactcctgaggctttaggaacacctgtcatgaaagtgggtttggctgacgtaggaataacagtgatacaatatgagtgccttttatttttgacagtctctgcgtttatcaattgcaaatgtacggtgtatacagccagcaatttgtcaaagagtgttgtagaaatatgtctgacccacataaaaagaccctatgcgtagaaaagttttgtttatctgaactgtatgctcagtaatctaacggggaaataagaacaacaggtttctaatctttcttggccactgagaaaaggggcttcatatgttgtaaaatgcagttacatgctatctaaagtaataataaagattgttttcagtcctactcttaacttcctacaatttagacattaccagtagaattcttttctaaagttcctacgaagtcaatacctcctgtctgtctattgcatgctttacactcaggactagagtctaaatccaagctgagcaatttattgccattatgattttaggcaattagaattaaggttttcttccatagctcataaacaaaaatagtatcacttaatgattaggcataaaattgctgagatgtaatataagagaaatattttgcatgcatcctaaaattctatagttaatgtacacacacgctcatacacaattaggcgtgccatgtccatcttttctaataaaatgtagttttaatttttaaaaatgatacaatgtactttacctaacatgtatattttatatatatattatatatatatgatatatatcatatataatatattatattatatcatatataatatattatattatatcatatatcatatatatgatattatatcatatatcatatatatgatattatatcatatatattatatcatatatcatatatatgatattatatcatatatattatatattatattatataatgtatattatatatgatattatatcatatatattatatattatataatgcatattatatatgatattatataatgtatattatatatgatataatatatgatatatatattatatatgatataatatatgatatatatattatatacatggtcatggtaggttttcacgacaggcatgacactcaaatctcttaaaataatttttacttctttttaagtaatcaatcaacatttgtttatttaaactttaaactttctaattcgtattttttaaattaattgtaattgacaattgtataaatttatgggttgcaatgtgatttttttcaacttttgttttagatacaagggctacatattcatgtttgttacaagagtatatcgtgtgatgctgaggtttggggtacaattgaacctttcatccaggtagtgagtatggtacccaaaggatacttttctaaccctttccccctcccttgctgtccccacttgtagttcccattgtctattgttcccgtatttatgtccaaaaagtatgtgttaaaaaacggttcatctcacattgactgtattccctactttatgatcattcagtgtagatggatggagtttccttgatggtggcatttaattatgcttacaaagaaatgtgatgaaaattcaggttaaaagagaaaatatatgaaaggaattttcttcatcaggaacttcagcaaggtaagtattgtgctgcaacagcatgcaatcatccaatatccacgtttattttctcctttctccctcattctacaataatgagaaaaaagcagacacatgtgattcctaatccaatttaaagttttgccacctgatggtagattgttatttttgaaccacatttagcaaaggacagcaaattgcactcagaattacacaatattcactggaatctgtatctttcattctaagtcgtttttctttctgcaattgttcacttgttagaagcaatatctgccactacttatatacatagaagagagcagctgagagtaagcattagttccacatcattaatatgagtattaataataataaaggaaaccctttccaaatggggatttatgtttgagaattcagtattttagtccaaaggaagaaaaacaggaaagtttttgggcaggcttttctctacatttttaatgatgcattgggggagggtgaggcaataagagacacagagaagcaggtggaagggaagtaaggagggatgagaaaagcagagtactgactgttgactgctcactgctgcctcccccatgttccccccccaccaccatttttaaagactcatcatttgtagctttatggaaaagaaactaatgcatctagagcagaaaaaaataaataatgtacttgtatcacttgtttattgctgtgtgataaaacactccaagacatctctagtcacgttgcgtgaagggtcaaggacacacagggtcacattcattagacgctgtgattgtgaaaacgtaccacagataatatatttccccaaaatattaataaatgcaaaagagaatcatcaatatttttaatttgagaaaactctgtatttgcaaatagttcaaaagcatattttaatcaaataattatactagaacttaaccattaaaataatcccaaatatgaaattagctgtttttcaatagtgaatcttgtgtaaggtagaaagacatttatatttgaacggttaaaattattaccacaagtcccctaatgtttcataacctaaggcatggatttggggagaaaatcaacaatttatagtgctaggcaagccaacaatgatacagtagtaagttttgatagataagaaattttgttggattctgaaatatacatgacaatatctgtatcctatcaactttatgaatgtgtcctatttggagggagaaaaggtatttaggagataaatctgacacagaattactgtctattattataaatgttaaattaaaaaaagttttcaaaataagtatctgagaaaaatgaaattaatgcctattttaaaacattaaaatacctacattttaatctcctaaacatataatttctttctttattctggcaacatccttatttacttactaagtttgtatcaatgttaaagccttcaattaaaaaaaagtaaaattgtaaaaagagcctgtcatcatgcgagtcacagtctagtagagtcaggaaagtaaattagtaaaatatgtcacgtcagatggtgaacgccaaggagacaacacaagaaagggaggtgggaagctcttctggtggggaggccttgcgattttaagttgggtggtatgggaagatgtcactgagtagatggtatttaaataaaggactaaacaactgaaaaactaagccttattgttccctgggacagtgagcatttcaggcagagttggaagagcaaatgcaagtaagtgcctgaggtaggcattcattggccaggtttgagctataacaggccagtaagacttgggttgagttacgtgggggatattagcagcagatgacactggggagagagcaggcatagaggtaggtagattgaatgaaactacaatggctaggtaagtctttataagaattttggctgtcatgtgattgatgtgagacgctatggaagggatttgaacacaggaataacataatctgatttacatttgaaaaggattattctagtactatattgaaaatagatggtgagtcagaaaagaaaggaagaaatatccaagccagttaggaggctattagagtaatcatatgagagaccatggtagcctatgccacagtaatcgcaacaaaggtgatgagaagtaatctggttttggaaatatttacaaggtttggaaggaagagctaataggattatccagtatcttggatatgggctatattaatcaactttaatttatgtggccatgacaaacaacctcaagtctttccccaaatgtcagtaatttacaacaatgagcattgatttcttgctcaagttacataaagcagctgtgggtctggctctgctcacctgaaggtcagcctggagctgcttgacttgtgctcatgtttaccatgcatcctagaatccaggctgtaggagcagtttctatcacataaatgctctattcatggcacagggaggggtgccatagccacagtgggcaatcttcttaaaagtcctgtggagttaaggcataagtcacacctggttacattctgctgccccaagcaatgtggccaagcccatgtggctgggtggggacaaacacttctcctacgggaggtctctcaggtctctttatctgacagagaagggagcaagcatttggcaagcacaacacaatcttcaacattgcagacaacagaaatcaaggcttttctcctaacaaactagaaaaatgaagtcactgtccaccgagatgggaaagacaacaggtagaataagtttaaaagcagacaaaaaattgatgataatatgaaactgtgatgtgatattggaattattttaaacattatcataaaaatttattataaaatgtagaaaatctaagttatcaaaagtctgatcagttgtacaagtgacatgaaataaggtactaggtcattttcatttgaagtgaaataaccacccaattcagaacaattaacagggggtaatgaaaatacctgtattcatacacgtagcccattttaaagtcatataattattattcacagatcatcagctacatttaagggatggtgatattcaagctgtcttgtatttcacatctctaagtgtcataaatatttccctttactatagaaaaagcaaaccagtatcaaatcgacacagaatgattatcaacgtatatatcccttgtgtagatgtagtattctgcaacccctgtgtaagtcctttttcacaacgctatatcatgcttcttacagcacttaagctgctggtacatgggtttctgaagaatgaggaagggttaatcagcttttggcagagatcagcaaaatttgcaagcattttagcctctccatcaagactcataaaatattttggaaactacaggacaaaaaaccaacccatccaagcagaaaattaaaaagcaatctgccagttcaatggaattcaacctttgctaggctgcaaatgatggtaaaatggttaaatattcattcatgattacccagagacataaagctacggtagaaacatgaaaaaaaaaatacatagactatgggcaggtgggaaagaaaacaggactaaattgtgcatcttatggagcagtgctgtttgttttcttttaacctgatttctatcaagatgctgaagaactgtagatttagataagatgaggaagaagagggggatcatctctccaactcctggtttaaaagggacactcttttttctttttgcattgaatttttgcctaaaatttccttttattatagacgtgttctctttttcttgcttgagagtaaaatattccacaaagtcaccaatcatgaaagtcaagaaatgtttgttgtattgactgttaatttcctaaaagaaaaacaaaacaacagcaatagttgaataagggaagactgagtttattaagcctgtcatggtaaagaagagcacacctggacaaaggagtgccttgaaaagggaagtcagaggagggtgtttacacaggtgcagcttctgggctgagtgatttttaaggcgtcttgcaagacagagcactggataaggccaggcagagtttagaacttaatagctttggattggtgagcacagtgtggcaagagtgttaaagtgattacatgagcaaggtcttaatcttgacagctaagctgtttacttggttcatggccttatattccagaagcaagcagttaaattatctttattggattcagtattgtttaatatagggtcagagaatggtgtccgtttcaatgttctgttgagagtttacctatcttgtgaagttttgggagaaaacttcaaccaagtttagagatatctgctccatgtcccaaacttcccagataagggagattactctggtatcattctctgccagacatcacatcaagaaataacagaagctgaaactggaattacattataatccataaaaggctgataacagaaagaagtattacaatgaccctgtcttcttcagaagatccaataaaaaggctatgcaagactgcagaagttactacctctaatttcttggcttccatacatatcattttatttcttttctggcctatgagtcccaaaatgtggcatagatattgactccaaagagaggaagtgattaaaatctacccccattggttagaagctggccattaccaatactcctggtatagcataaaaatgcctcaaacaatacggcatgcagtactgctctttgagggctagtgccaattaagggaacttgcatacttctgtttcttttatttttaacttactgttagaaaaatgttaactaaatttttgaggggaaatgttgtcattacagaatgcgtgtttcattatgcatatcctattggtgaataatttgcaaatcctcatttgacctaaggagtgtttgattgtcaagctttatatccccaaattgccatcaagcagataacttgtctctatcatttttatttttgatagcaatttttctgactctaagaaacctataaagcataattgttctaaaatatctccactattaatccttttagtctcattttttcagaacatactgaaacagaaatagtctgtcacctctgcctccacctgcttttcttcttcctccttgtacttcagagctaaggaatgaatacagaatttattctctcaggagagtgaaacaattgatccagtaattgccatgtcaagggttttggtgagagaagtattctaaaatcacaatataatgcaagtctcataaaggatttcctaaacagtatgttgctctccctactgaataaaatatacctcatcctacatttcctccttgaggtctaataaggagagacctatctggtctatggatttaacactctaagataatttactttggacaaagatctttggagaagcttcattatattttgaagtcattaacatgactcaagaaagtccccaattaaatgaagatgagtcatatgacagtaggcaactgtagatagtctctgcccctacattttgcctctgtagaaatattctttacattcatgggcttccataggcctgatgttttcctatttttgttgttattctgcttcattactgcaaatgtcagacctttaagagtgaggttattaaacagcaaaacacagagcaataggcatttgtaaaagatatatatccagggaagatgctgctctcccactgccagccatacaagctgaggcttccttctcatcactgaagaagacaaggagacaagaagcacattatgtcataaaggcaataggaatcttgcaagtaaccttttcaccagaaaacctctcatttgccctgccttgcatgtactgttcttgaatgatttattgccaaaatattcttgaatttcccatattgttaatttaatgttcttagtaacaaaaactaaccgtgggattgatataacagaaaattccagtcacctcagggcagaaattattattttaatctagccatgaaaataaacattttttttcaggaaactcaagtccttaaaaatgaggtgaagtgtgtctaccacaaagtgtcggcaagccagggaaagtcaggcagggtgttcaaggaaattaaacacatccagcttcttttttctactgtcttcttgtttagttcttctaaaaatcagttttgatggggagctctggcaaatgtttgtgttccgttagtttaatgtgatagaggaaaaaacattctggctggcagctaggctataaggggagtgctgagatttgaaacagaaaccacaatttataaaacgactgcaataagacttgtaaaacacataaattatagcaaaccacacaagaatcacagatgatctaagaatatactctttaacaccagctcatttagatctacatgttccaaggtaagaacacaaataaactaatctggcagaaaccatctagacttgtgttctaaagacaactgttccagtaaatcctctttatttgaaaattcagaccaatccctgctaaggccatcttatcaggtaattttggcccctaaactctaaaggtatccttccctgactctctcctttagagacccccccttacttcctgtgatatgcattctccctgtcaagcattttaataagtctgactttaactgtaatggtgttggttgctcttagctggaaggctttaacttaaaataccaggaagattagagagataactataagtaaaaatcatctaggttatgataaataagctgttgaattacatgacttgtttctaggatttttctctaaacatgtattaagtcaaactttctccaatttggagtgaagttaatgatatcttttaaagcttctctatagaagcagagagtagaatggtgattaccaaaggctgggaagaggggatgggagttggggagatgttggtcaaaggatacaaaatttcagtcaaataagaagaataaattcaagaaatgtattgtaccacatgatgactatagttaataataatgtagtattcttgaaaatggttgagtagattttaaatgttcttgccacaaaaaatgataaaactatgtcagataatgcaatgttaattacccaaatgcaaccattgcactatacatatacatatataaacatcatattgcacttaataaattttttttatttaaataagtaaataattttttaagaaaaactctccaggtgattctaatgttcaaccaaatatgagaaagtataagttaaaatattaacacctttcaataaaacattttttaaattacatgatgaattacatatataaaatggataggtccatggtgagtgactttgacatacataaacctcagtcaaggtataccccatacccaagaacattccctcattcccctttccattcagccccctcccataagtaaggattgtttttctagcaccatagattagttttgcctgttcttgaccttcatgtgagtgaaatcacacaccagagcggttgttaaagatgactgacatgagatccaaaaatgtcaacctagaatgaaagggcttcagctttgagaagctcttcagatacatttcactgtaataccctaattttccacttgagatcaacaagatcacacagctagttgatggcatagttgtgaacaaattcattgtttcctaaaccctctttactgatattccttctgtcattcatcaacatgttgataagtagcaactaaactataaacttcaaaatatatctaaaacctcaatttttactgcttctcctttagttcaggcctgatgaactacttaactaaactttccagacaaacttccagactggtctctgtctttagattcttacttatttattcattcattaaaaaaccactccttgggaattcatagtctaatgaacctcattttgcagtccactcctgactttattacacagatctgattatgaagtcttcattggttttaattatcagggttacaaatatgtgggctgctgactaaaggcaatccacagagctgatttttccttctcataaaattagtttaaaaattaaattacttgctaataattaaaactgggacaattctgagtgataatttagtaccctgagttttcttgaaacataagaatgtctaataacacagagttctcacttttcttctgtaatcactggaaactgaggagtgaatatgttctttagtttattacagctgcaacaagtgactcactgtgtttctgacaatgtggccacatgcagccacacttcatttatctgtcaccttcttacctatttaggcattttacattttcaccctagttttctgagatgaagtctaaattctttgtccaggcaagtgaggcctttgcctttaacagcacactttccgctacatcttactgaattatatccagcctaaaacagttgttcttccctgagtaacaaaatatgaatgataacactattttgattggaaatctaacaattttgcttttcttctcttttttcccccatagaaataaggaatagttgtattttcccttacttcttgggatggcatcctcacccccatgaggaaagataactaggatctcagttgattaggctttaaagttaataggaaattagagtctatatttaaagaacaagaaaagcagggcctttatcacaagaagcagagtgccttgaaggagttgatattaagcaggttgtgtttcttttgcctgctgagccgggctctagtagaccaatagtgaaaatgtggttcttgctaaggaagattgcaaaccagtctcagagacggataagtcactagatagtgttgacagtataggaatcatcacagggtactcttgtagcataggagggagtagtatatactagaggacctgccatctggactagaggaagttatttctaagtgtctgaaacttaggcctgaagagctagtacatatatgagtaagcaaagcaaaaaggtgtttaggcaggggaaatctcaaagataaatggatagctcaccaattcaaggtatctttggggtagtttaccatagtcacagagaagctcaggtaggagggagtatggaaagtcaatgattaggggatttggagaaaaattgagtggaacagaggtagaggatgaaatcattagcccttgcattttattcagtgtaattttccttctttcctgagggagtgggagttatcaaaatattttttggagaagtgtaggatgacagaattgtaatatcagctaccgtgaactgttcgaagttctctttgtaacacaaaaaaacaaaaactgatttattcatagtttattttttaaaaatactttaaattctgggatacatgtgcagaacgtgcaggtttgttacataggtatacacttgtcacggtggttggctgcacccatcaacccatcatctacattaggtatttctcctaatgctatacctcccctagaccctcaccccccaacatgccctactgtgtgatgttcccctccgtctgtccatgtgttcttattgtccaactcccacttatgagtgagaacacgcggtgtttggttttctgttcctgtgttagtttgctgagaatgatggttgccagcttcatccatgtccctgtgatcattaaaaagtcaggaaacaacagatgctggaaaggatgtggagaaataggaatgcttttacactgctgggagtgtaaattagttcagccattgtggaaagacagtgtggcaattcctcaaggacctagaaccagaaataccatttgacccagcaatcccattactgggtatatacccaaaggattataaatcattctactataaagacacatgcacatgtacggttattgcagcactatttacaatattcagaggttttatggtaatattggtaaacaaatatagcaaatagattttaaaaatgaaaacaatggatcatgatatattccacctcatatgatcagaattcatttagaaatgggcttcagggggcttgtggcattcagagaaggctttatataagaaatggaacatcctcctaaaggaaacatgggtgttgaactacagtgagattgggggtaaaacatttcaagttgaaaagtttgaggccatggtatgtgtatttgtgtgtgtagcttagagggaagactgatgttgggagattctgaaatgtgactgatagctaataattttgaaattgacttggtagaaaatttctgactcttcttaagcaggagagtggcctaatgaaaataatgtttggattattgcgtgtggcattcaagttttctagaatgcaaagattggtattagcaagagctgttggatggatagcaagatacactaccaaataaataatttagaaaatttgaaggtacaaaacaccagtgtaaacaatgtttccagagttgaaacctgaagctcaggtctccaaatcactttccctgtaggaggagtgaggaaatcagttttccttgtaatagagctgcctccccttctattctttctacttggtaccatctaagttatacttggtctcagaaattatcataacaggttgtattactccattctcacactgctgtaagggcacacccaatagtgggtcatttataaaggaaagagatgtaatggactcacagttccacatgaggggaggcctcacaatcatggtagaaggtgaaggaggagcaaaagcacatcttacatggtggcagcaagcagaagtgctgagtgtaagtctcttataaaaccatcagacctcgtaagaactcactcactatcacaagaacagcggcactggggtaactgcacccgtgattcaattacctcccactgggtccctcccatgattatgggaactacaattcaagatgaaatttgggtggagacacagccaaaccatatgagatcattctaacagtaataggtatctctgttgatgtatccacctgaagaagagagggagacaggcaggggagtcgtttaggtcgtaagcacttagtgtgacttttcagccacggtgtaagttcgagtgtgtccaaaggtctgaaagcccaaatttcacaggtgtacagaatgtgtaggtttaccaggacttattctactcccaatggcatctttgttttgcataagagtctggtattcttataattcttttcttttctattattttgagactttaattaagccatagagtgtaactgtaaattcatgtgacctgaaactgtaatttttattatgtttcttcttaatttacacattggaagccattttgttttttaatttttattttttgattttattttattgtggtaagaacccttaagatctatcctcttaaatgtttaaatatataatgcagtagtgctgactacaggcacaatgttactccagacctccctgattttgcacaactgaaatttcatgcctgtttatttataacttaccatccctcttccctcagctcctggaaaccaccattatggtctttgatttggctattttaggtacctcctcccagagaaatcatgcaggatttgtctttctgtgactggcttatttcatttagtataatatcctcaagattcatccacattgcatattgcagaattttctttattttaaatccggatagtattccactgtctgtgtgcgctcatccattaatgaacacttaggttgttttcataccttgggtattgggaatgttgctgtgataaacgtggaagtgctaatatctcttcaagatcctggttttaattattttggataaatgctcacggtggaattactttatcatggttttttttttttaaaggaaccttaatacggtttccgtagcagctgcaccattttgcattcctaccaataccatgcatgggctccatatcctcacagacacttgctgcctactgcatttttttcaacttttattttaagttcaggggtacatgtgtaggtttgttacacaggtaaacttttgtcatgggggtttgtcatacagattatttcatcactcaggtattaaacctggtactcattagttattttccctgactctccctcctcccaccctccactctcttttgaaaggccccagtgtgtgttatttccctctatgtgtccacgtgttttcatcatttcactcccattcataagtgagaacatgtggtatttggttttccatttctgtgttaatttgctaaggataatggccaacgtctccatccacatccctgaaaagggtatgattttgttcttttttatggatgcatagtattccttggtgtatgtgtaccacattttctttatctggtctatcgcagatgggcatttaggttgattccaggtctttgcttttgtgaatagtgctgcaaagaatatacacttttgactcaacaatcccattactgggtatatacccaaaggaacataaatcattccattattaagacacatgtcttttgcttttttcataatcaccatcctgagagaaatgaggtggtgtctcattgtggttttgatgtgcatttccctgatgactagtgacgctaagcaatcttcataggcctttgggcccttgtgtgtcttctttggatgaaagtctggtcaagtccatagctcatttttgttgatgttattataaagttctgttatcattgttgtttttgttagtgagttggagtttcttatatattttggaaattaatcccttatcagatataagatttggaaatattttcccattctctaggttttttttttttttttcgttttgttaattgtttcctttgctgtacagaagctttttagtgtgatatattcccagttgtctatctttggttatgttgtctgtgctttaggtgtcagagtcatgaaattattgccaagacgaatgtcataaaagttttcccatatgttttcatctaggagttttctagtttcaggtcttaatttgggactttaattcattttgaattgatttttgtatgtgtagtataagagtccaatttcctttttttttttttgcatgtggatgttcagttttgtcaacaacatttgttaaagagactatctttacccaatttcctatctttggtatcaagccattttaacaagaattttaacactatacattttctgagagatgcatatgcttaggatgaacagtttaaattactaaattgatagcacatgccagattaagttctgttatgtctttactgtaattctttgatatttttaatatttcaagtacagatacattctaattttgatttaattctgccagagcaaaatgtatcttatttgtttatattgaatcaatattaaggaaatatttacacaaaaatatgatcatatattttaaatatctgtactgtaaggaaaatgcttttatatcttaaaagttattgaaaaccatgggtattattaggaaacattagtcattattttgattaatagtttaggctaagtcacttgaacccctgatggtgcctgtcagattgtggaatacacatatatctatttgcagcctctctgtcataagggctatgacaaaaattattatttaaaaactattttgagtttcacagaaggaggctataatttctataaattcatgtttatgtgactttgaagtagattcaaacaaatgttattaatatcaatttatcctgttaatctagggacacagcacactgatatttcccaagaaagagtaaaagattgaaaggacatcaataggtaaaaccatcatttgctgaaaactctttgccctgagaagcagaagcctgtcaaagtccaacacaaccatatatcaacctccctgtcaaggacatcacacctgcagtagaatcaacactgtaacaggttgaggatgaccttagtgttgtgctattgatttagtctccatgttgttattagtctgatattctaaggttcaatgaatttgatccacataaagtaagtatcaaaaagaaaagcgtggaacctaaaaagctccagtcaaaagcaatcacttccaggttttcaaacataaaaattaaagggattaaacttggattgattaaacttaggggaacgggactagtagatttgataattgtgttatttgaagatcaactgaatttttgcacaaaccttcatggccaatagaaatgagttgtgcccccatgtacctaagggtcaccgatctgcaacctacaagtagggtgacctgatttgcctgagactcttccggtgaccaaactcaactcatcattgacattaaaaggagagcttttaaaatatagatcctatgggcagcaattcagagttacagagtctaaccttatagcagtgaggtccattaatctgttttttttttttttttttttttttttttataaagtacccgagatggttttgataatatgggtgcttgggaaactctcctccgaaaaacatagagttcctgatttggaaatcttgctgcttaaataaaatatgtgtatatgtgcacacatgtgtggtgtctatttttccctttcctttttccaaaatgccaacaattatttccccctgtgtattatgactatagcttgtgcaattacaatgtttgtatgtatcacagttgattctaattaagtattaagacgttttatatactagaccaagaacttatttaagaacttattcctctctttttctgtttgcaatgatcagcatagagcctgtatatagaaggtattccataaataagctaattaataagacaagacacttggaaccattcagatttttaaacctgttccacaggacattgaagagaaatattcaggggatgcttcatgaatgaagtgacacctgaagagaatctggaatacactaaggcccagacagggaggagaggtttataagcaggagggaaaaaataagaataataccatgttgacaggcatgattgcgggaaaatttgtagatggtggaaagtgtgatttggtaacgtaaatattttagattcttcaccaaggggcaataagatggcagtagagtcttagtaaggcacatgtgatcataatgaatatgtttggagtcaagagaagctggtataaggaaattctggtggatgtttacaccatatagtacgaacgtcctgctcagagtcaaatgatttcagtttcaaaatgtgccatgttggtgtgctgcacccaccaactcgtcatttaacattaggtatatctcctaatgctgtcccttccccctccctccaccccacaacaggccccagtgtgtgatgttccccttcctgtgtccatgtgttcttattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacgtaccctaaaacttaaagtataattaaaaaaaagaataagaggccaaaagacactaaaaaaatgaatgaaagaaacccatgccttatctcttgttatataagtagtgttatttattttctggtctatgtatgatttataccgcaggaccacatttgtacagagtccagctcctgagcaagcttttgtggtgggcagcatatgaccataaacaaagcttatttttctccttcttcccatctcttttcttccctcttttccttctccttccatttctccccaccttttcagagaacgagactgcattgattagttctgagttattcagctcatatgatgtaatcattttaatgtatgtgatgagtaagatacaatctcctcaatttcaactacagattgctgacataatgaaaaaaatatatttatatatgtcactggaaatagataaaaaatgcaactgatataagctgggctcatgaagggtcctataatactctgtggaattcacaccattctaacagccatgaagaaatactgaagtattttaagcaaagttgcaactattattatatattcattatagctttatcatgcctaaatactattgtataaagttttcttcccacacgtcagaaacaataagattctgaaaaatattataataaagttattcttctgacaaatgaatcctagagaaaattccccacctgcaacagttccttcctcagttttctctgactcaatacaatttcattcttttcgttttgcagctcaaaaatcttggtgctatcattgtctcttctcagtttctctcttagacctaacgcattaacttcacactactttcaaaatatattctgggttcgatcacttctaaccaaccaaatttaagctaccattggatttttctcacctggattattacggcacacctttaaattcctgtttttgctcctacccacaatatggtagccagaaagatcctgttaatttaagtcagattacagcacttccctcctctaacgactttccttctttctttcctccccctaacgactttccttctctcttagagttaaaatcaaatgcacttattgtaatgtatgagacccctcttggtttgtgcccccattatctccctgccttcatctgttttgactcttcccctctgctctctcctttagtcacatggtccccttgctttatgaacatcctggcattctcccgacattgtacatacatgcaatgcactcagcctgaaaagtctttcctcagataaatgcatgtctgactccctaattcccttcactcccttcctatcttcattccaaaggccactttccagtaaaggcttactttgccgcactgtctaaaattttaccccttctctccaaaactttttcatattcccaattgtactatgttattaatttggtgcaaagtatttgtggtttttgataataattgtgaatattactttctctctactggagagaaagctctttgagacatgtattttagtctcttctgttcactgttatatcccctgatatgtcagtatctgatacataataggtactcagtaaacatttgtcaaatacatgaatatatgaaattatgacaatatttgaaataattctaattatatttgaaatgctagaacatatatttatgtctattcttgaatcataacatagaagaagtctatagaaaactccattcttttatttcttatataatctatatattggattgttcttttgagctctgagaatatcaaattaaaagtactgaagtaaatactaattagtttctatcggtacctttatttgttctgaatgtttctcacttgatgtttagtgttagatatataccaagacaaaattaaataaaatagataagtgtttttcctataattcatcctaattattcacatttaaaatttagaagggactttattagatgcactttttatctatttttagataggaaaggccaatttgcattctcttcaaggaaataattggtattcataaaagttggactaacaatttcatttacatttgaaagaaaattaaaattaatccaatgtaggatattatacaaagattactatgcaaatatatttttaaaagttgctatatcacatagtgaacatttcaatggaacattctaaaaatgttgaggttttgtttcttaaaaaaaaaatacattcatacgtaagtgtgagctcttctcacttccataatagaagtgagaattatgctgtctgcgtactcatgaccggcatagttttccacaagtgctggctttaataggtgaatataaaatgatgtgattttttcttttttactgacatgaacattattattgtgcctttggttgaaataaatacttgaaatgtttgaacacacacacagccccatataaaacagttaaaaagttgttcttttgggcattccatttgttggtcagatatctgtattaacaccgattcatatccctcaagctgatgagaatgcagtgtaactaacgttgaatctaaggccaaaaagtatctacaaacaactggagccttgctggaaccatttgaggccgccttctgacctcctgtctcggcatatagctctgccagtgctttaacttgaactagtgagatctgaagcccctaaaaaaatactcatttttatagcttctaacgacagtatttgtcttttgtgtggaaatcatttttcagcctcaaacccttagattgggttcatgtggatttcaaaataagttgtcttaaaaatattttgctccataataattaaaacccatatcaacacatttttggtaactatttttttgcaatccttcatattaagagaattgtaatactttttttaaaaaattatatgcttagccatttgtatgtctttcctctacaaattcctcaaaagtcccacatatttttttctgaaatctcctctattctctcttagtttgttgtgttatattgtacatggagatgaaggatggtataatgtttaaaagatttttggctttctgaggagtgtttgtttgacttatttgcttttctgcagagcagtggacacagctcacaggctggccgtgctaccagctcttgctattattcactgtaaactcggtgtgcagggtaccgaccacagacagctgcccaggcaggtggtgtgcactgcacagagtctccgaggtaaggcagcgtaagagccagcaagacctttttaacaaaataggcgttagccagggtgaaaatggggaaattgcacatatatagcacttgagtgtccataagttgcatttcacctccttttttctcactgaacctcataatcatcctgagatctacttacgtattatttgtcccattttccaaataaagaaaatggggtaaagagaggttaacttatttgccaaataagagatagtggatgaaatcttgatcctcttactacaggtttcttactcttccctcagcagctcagcctcctctattgctcagcaggcattgtggagtgaatggcacagacctctccattcataagtccctctttcccattttctttctccttcaaagagcactggtacagtcacctgaaaagctaaagatgcagtgtgacaactgctacatcagcaattccagacccaccttcccacaccatctcacccctaccttgaaaagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtacacttatatatgtaaacatttagagaacaataaaagactacaaaacaatattatgtttaatgaaattaccatccaaaaaacgtgtttgggtgagcaagtggtaccacatctgagggaaagttgattgtgtggtagaaaaacagagcctttggcatcagaaggactgagtacaaaccttggctctgccaattaatattgggtgacctggaagaacatgtctaacttctccaacatacacattttttttcttgtaaaagtgatggttatagactcttctaacagaagtgttacaaagattaagtgattaatgtctgtaaagctgaagctcagtgcctagcatacaatccactctcaaaaaagagagcaggtttccacacctgtaattcttaataaacttcattaaatagcaatgtctaattattttgttacatagcaatattttatcagcaacgtttattggattccaacaaatattctttcaacaaatacacaaagaaatggaatatttcatggttatacttttttctattgtataatgtcagtctttttttttctcaagtagtaattaaaacttgctttgaaaaatactagtgtaacctaaaactactgtattccttaaaagtacttagaataaggagagggcagcaaaacaccacaggaagtataggggattgcatcccagacagacatggtcttggcttctggatctgcctcttggtagctgtgtgactttggatgaattgcttaatctcaccttgttttaagtgagataaaatggggaaaataatatttacctcacagttctgataggaggggtaataacataacgcatgtaaatcatgcagaacagcgtattatgataggtgcctaataactgttaattccccttcttctctttgttttactttcttctacttttctgtccctaatattctgatcataacacctccaggaacaaaagaagaaagacagaaatactaggacagttaagaagatccagtgagaaaaactcatatagagaagacaagattattgaaaattctaatcatttcactgaaactgatgtttccttgaaacaaacattacccataagaatggctgccatggtttatttaggaaacaaagtgtaatatttacaggggcagagaggacagcataagaatgaaaagagttagtgaaatctgacctttggtgagctggcactatttagtaaatctcccttgccttggtgaaagggattggcttccagtacagttaattccacatggaagagaaatataggagctttagccctgagggatattgctctataagcccaggttcttttcagattattctggttgattaaacacacagagaaataacccttttaaagttgtacatatattaagaattggagtaggcatataagcatcaccttacaaccgacaaaacagatttccaagcaacatacaatttaaattaatgcagttgtacgtaataatgattattttccaaatgatctatttgattggtatacatgctttctgactcttctcccaacagtgccatcagctgtaagggaaggattgtggactaaactcactcccgatatttagattatgaaggcaaagaaactatggagaggataagacaggaatttttaaaaggagaggactaagaagacaggggcagtatgtactatattgttaccctcccaggctggaggtgtggaaaactattataaaccgctaatgatcatttttttggtgttcgttattagaaccaatggaaggaaacatagcaggtgaacctcactgtattctctaaggtctttccagaaaagttgtgcctttataattaattctattgtctattagagtatacagttaagtgcatataccaaacttctttggtaaaatgtatagaattaaagactttcagggctgataagaggcccagtaagtcatacaggttagaattctcagaaagttaaaagccttatgagaaatttccattggctcaaatcagatgagaataaaacttgatcctacgtgtcttaatattcagtctaggagacttgccagtacccagtgcttctttattgactgattaaccattttctaactcactaattaggcaaaccagaatatttgtatgctccctgtgtgtgattgtctaggttgcaaattgagctaatttaattttgttgtttacaattgatacatttatttttgatatcctttggtagccttttgttagaggtgagagttatagttttatttcctgatcacactatcatctcatgttaaaatgagggtaaaaacacaacaatcaaattctacaacattttcaaacacttattagcaatgaaacagaaaatgtaatacaatctaccctgtaagtttaattaagtctcaacctttgtgttttttagtactgtgacaaactccgggcatgacagtttcacttagacagacatgacagttttctgttagcaggacctggttaccttgtagctggaatcaggccaaagcatcttctggaagaggttgctcataggacttgtggacattcatagcctgaggcaccggggtgaagagtggaagtgacactctaggtgctgggacatgttgtgcacatgacagaggccccacgtggtatcttagcaagtccacatgttttatgtcactcatgaaacatttcagtaatgagaaatcattgcccctctgcatgatgataatgaaaattttgaaggttattaggaatcagcatagctgatggattataagaacgacatctggcatgtactttttttttaaccactttatttgggtatgattgacatataaaaactttacatatttaatgtatccaactcaacaaagttggagataagtatggacccttgaagccatcaccacaatctgtcataaccctatccatcaacttcaaaagtttccttcttcctttttatttatttattattattatgatttttttgggggggaaataagaacatttaatataagaggtacattcttagcaaatttttaagcacacagcaccgtattgttaactcaaggtggatactgtatctctaagacttattcatcttggaaaaccaaactttgtattctttaactaacactatcttctcccatatctctcctgatcccacccctggcaactaccattccactctctgcttctattaactacttcagattcatcacctaagtggtaccatgtagtatttgttccgtgtctggcttatttcacttagcacaatgtctacaagattcatctctgttgcctgagtgtgggattttgattggcatctcaaatcctgacaatttctgcagtatgtttattgtacgagtttttcaaagatttgccaactgtcccataaaactaatatgcatttaaaataaagtttttaaaaatataacaaacaacaaagtttgagttgggcaggaggaatatattttgagatctactgcacagcaggatgactatagtcaataataacatattgagtatttcaaaataactaagagagtaggtttcaaatacctgaccatcatttcacattgtgtgatatgtatatatacatacacacacacacacatatatatcacattgtaccccataaatgtatataatttatcaattaaaataatattaatttggccaggtgtggtggctcatgcctgtaatcccagcaccttgagaggccgaggtgggcagctcacgaattcaagagatagagactatcctggctaacgtggtgaaacctcgtctgtactaaaaatataaaaattaactgggtgtgttggcgtgtggctgtagtcccagctactcgggaggctgaggcaggagaatcacttgaacccgggagtgcggaggatgcagggagccgagatcacgccactgcactccagcctggcaacagagcaacactctgtctcaaataaataaataaataaaataaaaataaaaagaaacagaaaaatcgaattattttatttcctatgaataaggcatttataaattattgtggaaagtgcctgtataacagaatattttttgaatatcataagtttgatatttatttcaatcatattttggatagatttcagcccattgctaatcatccattctccttgttttatgcaatgtcaaagaccacttcattttgctttggataaataagttttatttgatgaatgctgttgtcatttaaattacatacaaaaaaaatgacacaattacattaaatacatggaaattaaatgcccgtctccttcctacacacccacacacatttacatatctatacctttgtcatgtcatctcttcccacaaattataattttagccattttttctgtatttaaaatgaataattatctttcaccagttaaaacacttttatttgcttgcagaaacgtaatcattttctaataaaatagtagcagacactgcagtaaattctagccagaatttggttattatattaatctcacttcccatcactgaattcctttgcagggtaattagattgctatctgattctatcttgagtccaccaagtcaaggtgcaggcaggtggaaagtgtgttaaataagtgtcctgcttgatgggttctttttaatgccgatgagtttgtgccagtacaaataaaattatataaattactgtcaatcattagaggtttaaaaaagccaggttatttattatgatggtgtatatacatatatgtttatatacatatatatgtgtgtatatatgtatgtgtatatgtgtgtgtatacacgtgtgtgtatatataaatatgtgtgttatatgtgtatatatatgtgtgtatgtgtgtgtgtatatatatatatttggctaagagtttcttataagcatttcatacatggctaattatttctccagctttactatgcacagctatcaacctaagccctactctagctgatcatccctaaattcccttcagaatcctgccatattagagtaggagaaagagatgatacttttgtgtcaagtgagtagagtgagaatatgtcagttttcatatttatagagtgacgtttgacatctttaaagagaagttcctgaccttccctttgtctttttctaaccaagaaaatgtcagccacttccattgcctatctccagccgcatctagtacttctctctattccaaagcttcaacatactcttctgtcattatctgatcatctattggtcttcctctttcatttcaattcaagggaccttgacttatttctcatggttgtcttatcagaacagttcctgatgaaattaatttactgaatgctggaacaattccagccttcattacataaggaattcagtgaaaccttccttaagctcacaactctagtgtcaattatatattataaacacacaatcacaaacatttttaaaaacatgtctgcattataatgtcaaaggtagaaagaaattgcccatcatcgtccaggttgtcttgaccatccttaagagtgccttctacatttcccttccatattttctttaatgatagaaaattgtgtagaagacaatagaagaggaactaccccctctaggtcaataagacttttcaaccacccccaaaggtaatatctaaattgtacaaccagaatttacctgactggccagcatatataaaaggggccattacaaaagtatggcacacaggtcagaatagagatattcttctgaaacaaattacaataaggtcgggtacagtggctcacacctgtaatcccaacactttggaaagccagtgcaggtgaatcacttgagcccaggagttccagaccagcctaggcaacataatgagaccctgtctctccattttttagaaaaaaaaattagcagggcgtggtggcacacacctatagtcctacctacttgggaggctgaggcgggagcgtcgcttgacctagggagttccatgctgaagtgagcagtgattgaaccactgcactcagactgggtgacagagccaaaccttgtctcaaaacaaaaaatgaagaaactccacaaaatcacaatgacctcctcctccacagtcaatgatactagtggtgaaaatgatatgaaattccggcaacttttaaaaataaaatttattcctacaaatttttgttgtcgttgtttattgtttttgagacagtttctggctatgttgcccaggtcataatacagtgatgcaatcatggctcactgcagcatcaacctccccgggctcaagtgatcctctcacttcagcctcctgagtagctggaaccacagtcacacaccaccatattcagctattttttatatttttttagagatggggtttcacaatgttgcccaggctggtctcaaattcctgggctcaagcaatcctcctgccttggcctcccaaactgctgggattacagcatgagccgctgcacccggcccaaaaacatttttgaatctccttaacttgtttctaaatcaccactcttatttccactgaccacttaaacagatgacttgaattagttataaaactgctctggctgtttaatagatttgatataaaatacttttacattataatagatttgttttagatatgagtttttctttttgggaaaatgatattaaaataaattttacttatatttttaaaaaaatttctcattttattgatagggtatgttttaaaaataagattctagtcttccattaattaaaacttgtgctaaaaaattaaaaaggttagcctttcaattttaaataccaaatatagaaaacatacatgttaatttacagaatgtgtacttgataaaccaaacttaaattgagcaaggaacaacatgacgcattttaaggcaaatacataataaatgctaaaatgttgtagcaatattctggctttaaagaaatattgattaaatttattaagactgggctttgtctcaacacttaatggcaactatgatttaaaattaattaaattatgtttaacgctactgtgcatgtccttgaaacctcagtcaaattatatggtcattagctttcatttttatgataatgaaacaaaaaatacagtttccaaaatatatttttcactaaatctatggctaaaattgaatttaaatttctaggtttttttatttaatcaaaaaggaattttacaattcaatcaattgattgaaactaaaacttcaaattagggaggatttaattcaagcctgctattgtatttattattatttaaatataacatgcagacgcctaaactacacagcagacactctattaggttttgtatatatagaatcacacacacatactcccctagtttgtgagaaagtgctctaatattacagacacagattaaagtttagagaaatcaacttgtccaaggttacatagctagttgcacacacagaattttaaatcattcttatgtgactctaaaagaaaatacggaagtgaactgattaactttgcagttaagtttgcaggaataccctgggcaacacagaccctctgtcacagccaaatgttttgtttcgttgttgttccttaaatatgaccaatgctgtcaattctgcaactatattcttgcatttcctcatggctggaaggtctcatttttttttctgtcctttagatattaatcatcctttaaggctaactgagagccacatattcaaagaagacttccaaaccattacactattgaactatcccagcttttacctttctcgtttgggaacttagagactcaacttatggtattattaatactgcctatcctcagaccccagagacaaaacatgctgtctactttctcagtatcctccagagagcatgttatagaaattgacacatagaaatgatctagtcaatatttatttactaccagttgctggtacctggaaacattcttagtagtcttggttttcctggagtcctaatatagtatagtacagccagagacctgtttggttcacagaatttaagtaaacttcttgatcttacggtgtctgctagcatcatgagaacaggcaatgcaatatcttaagaccagttaaaaggaattagttttgagaaaagcttatagaggttacaccactttgcccttcacagaatctttcatttcagccacaaacccacattatcaattccctttataagctgtggatgacttgtcaggaaagatagtaacagtcaaccaataaatggaacattgtctccctaattcattcagagatgtttgcccatggagatactacctggtgatcttgccttacaacatcttgggcccagagatattgctgagattcttgtatttcccctctcatgtccagcattaatgtataagtcaaatacccatattctgtaaattctacacatctaccagtaggcaaggctggagatccaagttcttattatttaatcaactaatcagaaaggaagttctggctgatatttagaagttctgttaacatttcatagaagtaaatgtacaatttcccagaagaaaagtatcttgggaacacagagaccatctacatggacaaaagtaggggctaataatgatatgttacctcttgatattttagagaggcaacattgcttagtgcataagagtcaagacctgtggttgaagtcctgttcaactctgtactctcaatattaccttaggcaaataattaatttctctacacctttatttccttatctgtatctatatctctgtcggttgagttacagagagggtagctatgaccattaaactagatattttctggcacagagtaagtacttaatatacaaattttatatatgtttcatatatcatatataattatatattagagttgtatattatataacaaatatacattatataatgtagtttgcaaataaatattatataatgcaacatgtaatattatatagtatatataatatataaatgtagcatattatttaaaaattaaaaatatgtataaacatatatttagaatagcttacttcaattttatttgaggaactcattttttggctgtccacaacataaggagtaatggattattggtagattttcacagtctgattgtcttttattagatttagatcttctttctttccttctcatttctaactttattcagtttatagtacttagtagtttacaaaatatgtttacatatatcattgaatttgatactcctaagaaccccataagcaaagtatgatctcttattatacatattctatagataagaaactgagcatctagaagttaagtgactgctcaagatcacgtggctaggagtttacccaaagcctaaacttaggtcttctgatttctaatctagtgtttctcctactataatatttcagtctgctttttcctttcactctaaggcttattattttcactaaattcaaattgccttttctgctttgttaaatactagagttagacatttgtaaagttaaacacacacacacatacacacacacacacacgacattaagggcaagatatatacttccaaggtttctgagaggtacagcttatacaaggaaaatcttttgtaagaaattgtatagatctacttattcatgtgctgagtacacattttcaattttgactattggtataatttagagaaattcaattaaaaagaaaaaaataagtactcctctttaggcatttattctgttcacctgaaagtatattcatagccattttttttttgttaatgttaaataacagatccctttccagggatcctttccagggatccgttaagtgcagtccatgttagagttaatgaaatagtaccacagtttcagagataataaatatatgggggtaaggaactcacattgctacgcttttttattctgtttgaagtgatttgctttttgaaaaattgaaaatcagtggaaagctagtgaataagactgattagatgcagaaaaccacttgtgttctacaggtaaattagaaagtttgttgctacaaaaaacatcccttcgaaatgtaggcatacacaatgatttttaaagttgttagaagaagtctgcacatgagctgttcattttctatttagaataaacgatgtgagtggttttgactcctttctcccagtggcccatgccatacttcaaatatgaaaggaaataaaactgcaagctttaaggaaaagataaactctcatgcctgctatatttgcagagtaatcaaggattatggtatatttatcccatttcctcactcctcccttcttgttatttcagtcttcctcatcaaaacacttacttttcactgaatcctccaaattagcttctcatgcatattcaccggcagatcacacagtgactctgtaatggctgcagcctctttgcaattgaggcacagtgggccagacccccaccaggcaggttgcctgttgctggtgtaggctctgggaggtgaacatcagctttgttattccagctgggtgctgcagtccttgaactagcagctttagtcttccttaagatagcatcgtcgttttaatgagagtgaatgcatagcaataaatgctatccaagtcacaactggaattctcctaaggggagatgacctttcatatttttaatgaagatttatctttcaatttccatgaagcaagtggctaggtattttgttatttcatacgaaaataaaaggcatctcatagtaattttttctttgaaaattatttctcaaatttttagacttttagtggaagcgcttttatcttggaagattccactaaaaaagtagaatatttaccactttgggaggctgaggcgggcggatcacgaggtcaggctgaccagcatggtgaaaccccgtctctactaaaattacaaaacaaattagctgggcgtggtggcaggcgcctgtagtcccagctactggggaggctgaggcaggagaattgcttgaacccgggaggcggaggttgcagtgggccgagatcgcaccactgcactccagcctgggcgacagagcaagactccgtctcaaaaataaaaataaaaataaaaattaaaattaaaattaaaaaaaaggaaaagtagactatttacaagatttacaagtaacctagttggattataacccttcctcctgcaaatttatttttctatgatcctagaaaggtcttcatagtataaggattcttttggacttttgtgttggagataacagctaaaagaaaaatatccatcctctgacacacatacatacctcattgtatttatttacttatttattttttattttttaatgaacttatggcttctactttcatagcaactgactagaactacacaggaaactatagacagcaaccttagttatttcctggtttaagtgatgggatgtaatcatactgtatagttgtgaatagataataaaattgcatgacaaaaatgaaattgagaacagacttctgccacccttctgtaataaacagtataggaacaacactagacactagaatgataagaatgtgtcaggaatagcccaatacaggaattcattttttgtctgccttggcatactgcattctttatcaacaaaagttatttttaaaatgtcacataataataatatatgttgtccctttttttaatcttaaaggatcacatgttaaataaaaggaacaattagtagactatatgaataccttcaaagcaattttctaaaacaataaatgtagtcagatttgaaaatcaatcaatttaattatatttgaaattatgatagtaaaaatctatatagtcttaattattagattatagtttacctatcttcattgcatttgatgaaaaactttaaagtagaattatactttgatataatttagttttacttaaatttgttgttgcactaaattatcaagctatattttctttcctggttattctaagtagtgtcaagcacatatcagaaaacccactaaattggtactttaacttttaaaaacagtcttattagtgccatgtggtttaaaacttagcttaattcaaacagatataattttaacttaaaactttttttgggggacggagtctcgctcagtctcccaggctggagtgcagtggcgcgatctcggctcactgcaagctccgcctcccgggttcaggccattctcctgcctcagcctcctgagtagctgggactacaggcgcccgccaccacgcctggctaatattttgtatttttagtagagacggggtttcactgtgttagccaggatggtgtctcgaaaaacattttttatatattaaagtgtttttcaaatttgacaatgtagaaaactataatattttatttcaagaaatgtgtataccttaatccaattagcacctagattctgacctatgttggcacatagtatgatcagccagggcaccagcatcttgattacagaggtgattggatagatccacccatgtcaagcagacccaaatgttttcttttgacttcgggctttccaaaagatacagtagagataacagaaggattgatgaaaggctgaaaccacactatgaacagcatacgtaatctactattaaaagttcctaattagggtagcaacaaaaactttagtcagatctggataaggcagtatctctggctgtgttcttgtctgtttctcctcatcctttttctgttattctcttaatttcctgcagagaggtagacattttagtccacctattttgttaatacaaaggagcagtttctttatattgtcgttaatttactgatcgtataggattatcaacctctttcattgcttaatgttcaaattttaaaaacactttttcataaactatgcttgcttctattgctctaacaatatttgttcctatgttctactctaaattatgcaggtttaaaatctttctcttattttgctgcattcttgtgaagtctgcatacagattcttgattcaaaaaatcatggtttctgtacctcttcctcaggagaggttttacagattctactgatttttggtagacagaaaccaacttttaaccagtgtactacttggaaaaactctttccaaatactgtagaggaaagatgttgggctttgaagccaaacagacttgtgtttgaaacctggttcccatgtttccagctgtatgacaatagcaatttacttcctaaacttaatggagtaatatcgtattaatatttatcccaaggtgtgactgtttggattaaatgagattatctatgggtgtcccaaagtcacgcaaatcacaagttcccatcttgttttttctctgtggttacttctttttattttttttatttttaattatttatttatttatttactttttgagaaggagtctcgctctgtcgcccaggctggagtgcagtggcgcaatcttggctcaccgcaagggctgcctcccgggttcacgccattctcctgcctcagcctcccaagtagctgggactacaggcgcccaccaccacgcccggctaattttttgtatttttagtacagacggggtttcaccgcgttagccaggatggtctcgatctcctcctgacttcgtgatccgccctcctcggcctcccaaagtgttgggattacaggcgtgagccgccgcgcccggcctctctgtggttacttctaatgttggaagtcatcacagtgaaattctttgtgctatcttcaccatgggaatctttctgtttattccatgcccaattacatatatttcacatttcaaactttatcttgagtgaaaagaaagaaggactagctcctgatatattcctcatggatattctcataaaaatttgagtgtttcttttccagtaaagtaagttaatcctttccaacgctctgattattagctcagcacctctatggtattatagttctttttgaaaaatactgcaataattttcattttcataaattcagtggaaactgagttgctccaggtagggtagcccaaagctgactgacaacttcaaagctcacagacaagggcaaaaagcatgtgtgctgctccttgtgaataatactacaggaaaaaaaggcaaaattcctattcaggtaggtagatggtcaaaagagtttcctacaagacagtgtcacgtgcaattttatctacattgttataacttccctacctgacaagacagtgtcaagatttgttaatgagatggcctcacaagtgtatatttaaatattttatgaaaagccattgtagctttctatggatctgacagtagttaaatgcatgagctcccaaggcctatttcaggggctacgtgtatatatctttttccttccaaagacagatgaaggtgtgcaagtcactctactgatttgcaaggacaagaaatgtgctttttctctaattcattctgatattagctattggagttctctttgccctatttcagcactgtttgtacataaatacaccttattactacagaaaaaaattccatgatgaaacctgaagtgctttaatgcactggtctgtagacacagcccatttttttttttctctttacctttgattatcaaggagtaatttgctcaccagcaaacactggataatgtaatatataactttctctaacagaacagaatacagtgagtaggcatttttgaacggtctgttttgatattttggtcccactattctaaattttggggatgcttgtgcggaggtaatgcttaatctggtatcaaataattgctatctgcatctgtgctcattaaatatcattttttaatccagaattttttcctgtactaaggacaaaatgaatattaggccttagacatttttatgtgacatctaaaaattgaagcaggtatatctctaagtaaactaataatggttgatgattttcataataaatgtgcacatttaacattttcctcttcaaattctaaaggttggaaagtgaaggtgaaatcctatatgaaattgtctatatatgctataggttataaatccagattatcattttagattctgtatgttgacatgacatgtaagaactgatgttgtatgaagagtaataataatgatattagaacaaaatgtaatttcctatcagcaatgattagtatttaataataaaatatattaataattaaacattttgaatatagccaaaactttgaaataagaaatgaaacacttaggtaataaatgagaatttagtcacaaaatactgaagtaatattttagctaacttattagcatttagccaaataataagaaaatacttaggttccacttacctaaaaataaatctagtgatgtttccagatgtttagaaaatcattttctttaattaagagatagatacatttctgtgttgtaataaagaatgcaaggagatattttcttataaacctgaaaaagatgtcttctgaatattctggaatctgttttgactcatcggctctattagactttttagttaagtgtctgtttttaagaagatataattcatggtgtactcaaaataatactgttggcagactgtatatgagctgtggaaaggattgcaaactgtaatgggaagtattataataggggatctccactctgctcagatacagggaacatttgataaaatatttcttgaatgaatgattattttacataattattatctagtataatgctatgttttcagataaaaatattttatgtgaaaatatttttatcagaggtcaactttaacgccaccaaaaaattgaataaacatttttgttttgctttcatttcaggtactagaaaattaccttgcatatcattaatagtttataggacttttatttgggaggtagttttcaaaaagttatgatttttgtctagctctgagctctataccagcctctccatcccatgcaattttcatatgtcaacctattaattttgaaacaaaacaaagatgcattgaaatatttctaaatgtccattctacatcgagttctgcaggcgatagtgttgttgcataggcatttaaacatttaaaaacttttcttttctttctttttttttttttttgagacgcagtctcaatctgtggcccaggctggaatgcagtggcatgacctcggctcactgcaacctccgactcccaggttcaagtgattctcccatctcaggttcccgagtagctgggattacaggcgcccgccaccacacccagctaattttttgtatttttagtagagacagggtttcaccgttttggccatcccgacctcagatgatccccccacctcggcctcccgaagtgccgggattacaggtgtgagccaccgcacctggccaaaaatcttttcaataaaacgtgagttctgtgggttgcttggaaaaatatattctagggttctttgaatttaaagacactaagtactctattgcagtcttgaatattaaaactcaaattcacattcacattttaaggtttatgaaaagtcaaaaagtccagaggattatttagtctagacctcttaacctagagctgccaaaacgtatttgagcagaaaatctgttttctctatatttctgttgtcttttttttttttttttttttgtaatccctaaaaacatccaaggaaaggacattgaaaatccctgggaaagaaagcaatgcctcctgagtttgaagactgggtctcctatcttttttctttacagtctcagacttagggatgtctttctttggataaactatttacttccttcattttctttacttgatctttcataatgggttacattgctattaaccaaaactatgaaacatgaataaagctgagaaaaccatcagtcaagtaacaggaaagtgcgcatatttgcccatactatggacatcccaatgttcccagcgggcaggggacaaggaggacatgaacatattctccaaagccaggggagtttcaataacatttttaaagtaatatgttgccattatggttgtcaaaactataatggcactatgttagataaaacagtatgaaaagcaatatcataaaaaagtagataaaggatggcatgattttatgtgttgaattccccaagatatagtacatttgtttttttccttgtgaccttggacaaaagtaacgatattctataaaaatgtggtttgtataactggagttagtgtcaggggtaaaatgaaagttggaacaagcagaaaaagaactatgtatggaaaagaaagaaaggattgtttaacaaactggtgatatgggtttctgtgaaacttgtgtagataagctggaaaaagatgaatgatggaggagcacccaacaaatattaatatataatgtcaacttaggggtaaatatcaagtgttatgcgtctctttgggtccttcgatttctccatttcgtacagtgctttagaaaaagacacacagatgtgctctcctaagttttttgtttggttggtcctttttattttttgagacagagtctcgctctgtctccaggctggagtgcagtggcacaatctcggctcactgcagcctctgcctcccaggttcaagtgattctcctgcctcagcctcccaagtagctgggactaccagtgcacgccaccatgcctagctaagttttgtatttttagtagagacagggtttcaccacgttggccaggatggtcttgatctcctgacctcgtgatctgcctgcctcgaccttccaaagtgctagcattacaggtgggagccactgcgcctggccttttgttgtttttggttttggtgattggacaaagaactctggagagctggagggatgacagaaacattgcctgacagaattatgacccaaagcacaactcaagcatatcaagcgctctgagaaattttaaaatatcatattgaatagtgtttaaatgtgctgtcctacatttgattggaaaaggacacctgcataaagacctaagaatgatttagcggcagtgcacacaaagaggagtcagttatttttacttatcaagcttgcaacagcacagtgtgaggattttgcgttcctgagcctttagtgtcaaattttttgtgtgtaaatccaggctctgacattagctatgtgttcttggtcagtttcctaagtaagtgtttgtcaattaaatcttttcttcatagggtttttcttattttgttaaataggattgttaagtggattaaatgagataggtgtaaaaaaatgcatgttatattatctggcacataaaaaatgtggtttatttcaataacattagatgttattatgttgtcttaattgtttgtatctggaaactttgtttctggatacgccatttaacaagaaatagaggctcactggaacatgctaagaggaaggaagagatacctgtcctatgaggcgtgcttgacaggattcgagtctggagataaagaccatgtctaaatgtcattccaatcctgggattccatgattttagagtatttctccttaatcccttcacttctctgttctttaaaacaaaacaaaacaaaacaaaaataacacgcatttttcttcatagaattctgtgatgagttgtattggtttttgttttgttttattaccatacacacacgttcacgcacacatagagcaaaattatctaacaattccatttttgacataaagttaaattgttttaagtcaggcatgcaatattaattaataccaactggttcatacatacaaaacaattaggccaggtgtggtggctcaagcctataatcccagcactttgggaggctgaggtgggtgaataatgaggtcaagagatcaagaccattctggccaacatggtgagactccgtctctactaaaaatgcaacaattagctgggagttctcgtgcgtgcctgtagtcctagctactcgggaggctgaggcaggagaattgcttgaacctgggaggcggaggttgctgtgagccaagatcgcaccactgcactccagcctggtgacagagcgagactccatctcaaaaaacaaacaaacaaacaagcaaacccaaaaatacaacacagtttcttataaaatgtatgtgaaaacagaatctaattttgtctctctttttctttcttactttcttcttcattttttgaaaggagtgggaacagtagataatgacctactgattgacacaattgctagacttttatccccactaccagaggtggctacccgtgggctccaaatcctattctgaagcatcaggttgccaagcaagtttgcacactgcctttctttcttcctttttccccctcttgtttcccctcatacatttttgtgtcagagattgataagttttgacaaaaggctagtggcttacattaaaaagttagaaccccaaaagccttagcctatacaataactgttcatttaagctctagtgatacatttacaccctggtatgtcagaagaacttttttttctgtcgcccagggtggagtgcagtggtgtgatctcagctcactgcaacctctgcctcctgggttcaagcaattctcctgcctcagcctcctgagtagctgagattacaggcgtgcaccaccacgcccggctaatttttgtattcttagtagagacagggtttcatcatattggccaggctggtctcaaactcttgaccttgtgatccacccgcctcagcctcccaaagtgctgggattacaggcttgagccaccatgcccagcctagaggaattttttaaaaagctaacactttttagtaaatatttacttgtaattaattgtaattattggggaatagatttttaaaaattaaatacttagggctgatccaatcattacatttgtatatttaagtacatcccatttaaacttgtctattactatattaaagttattaaagcaagtgaaacaggagtggtgacttttctttgagggaattttaatactggtggaaaaggccagattgccaacttttaaaactgaaatatgttgtcagtgggaacaaagtttgaaagaaatgtaacacaattttattaccaatgtctctaaggcgataaaatctttctaaacttggtagaaaaatataagaatgcaacttcctagcagccacatggcagttaattttggcaatctgttttgggccattgtaacccacaaatatcaataataactgaaatggcttaaatcttgtctaccgaaaggcttacgaaaaaggaaaagaaaggagagagggagtgaatatgggaggaggtgaagatacaccttaatggtgattcaaggctgcagcatattctgtgtacaaataaataggcttcaacacctgctgatgtgctggcatctggcctgaaagcaaccaacatctgtttgtaattttcagtgggagcccatgacagtgaagaactgtatactgtcactgaatatatggccttgttaacatactaaaaggatccagaagtgagatcatgaatggataatttgggacatgtgactcccatgtgatacggtgataagatttgttgggttttctttaaaggttgccattagagttttatcctgaaccattatttaatagactttaaacgttggaaagtgctttctagaggaaagcttattttaaaagagaattttcccaaccagcttacatcttccacacttttaggggatatgtgttttattggggtagatatggacattgtacaacagctcaaatttatgtaacccccagtgcccttgggagagcccatggagaagaacccagagtgtgagcaggagtcacagtggggttggctttgagcctcaaggcaggtcagaggggtacttcaggagtcctcctcccctgtctctaaaaacgctggagttcttgtgcttcttgattatggctccaattgtgatattttaggcagtaactcaccgttttgtcacctttcctctgatacaagtgctgatcaagttggtaaactcccaggtcagaaaattggggaagactttcctacatttctgttgagggaaatgaggaactgaggccttagaatttctctttaccatttcctcataatcaggaaagttctagagatgattttgtaaaatagtacattcatatctatctcgatggatcatgaccatttttctagtttcacggattcagtgaatgaattctctgttgtaattatttttaggtgtaacactatatgtagatgattgataaaatgcctaactcctaagagtggtgagggctccaccataataactacacatgatacatcattacaatcaggctttcattcagaatttctaaatttaagaaatattacctattatttgataatcttatcacctgccatcattcatttttgcaaatttgaaattttgtatctaacttagattgctgaattagattagcctaatataataaattcttattacattatttttatttaatatttaaagtgaagactatggaaggaatttagtaatgcttttgctagttaaaaacagtatttagttaataaagataaaaacaaaaatattgttctgcacaggggtaaagaggtaggtatctgtgacttctcttttattggcagttaagtttttgcctaagtgctgagactagatttagagcttccttctacagagatttgcctacgtttacaaacatacacattcctttaaaaatatgtgctgcatttcctcaaaaatctaatttttattttttaagaagttcaaaatttaaagcacttctactgtgactgtagaacaaaatagtggtaataattatcaagaatccaacatgtagatttaaacaagctatcacagttttcatctaattagacttttaaattttttttgtttcgtgattaattttaaaatacgtattcagggaatcaagaaaattttcaacttaaaaaaagtggatttctctgtgaataacatacaaaaaaagcttagtataaaaataaaactcttgaatatctacataaaggccataaacaagatcaatatttgtaaagcaatttcctttgctcattaaaaatgcacaaatttaaacacattaatatttaatttcatttttaattataaagaatacaagtaaaaatcaagcatgttcatttttgatggcttttgaaaagtgaagagtttgaaaaaaagaaagtgaaaaaaagtgaagagtttgaaaagtcagtcattttgttttcattttttgactcaggattgcttgggagagataaggacatgtgtatagatacagagacctgggtatggtaagtagtgggagtagaaacccaggtcaaagttgttgcagcatagaagtcatcatccaactagtctccatagacaatcattttaattttctatgcctggttattaattattctaataaaattagttatttgttcctaatttctttaatactgactacttttcacagttttaaagtatcgctaagttatttttgcccattaaataatatttctaagttataatatattttccaagtaccagaaagtaaacccaacaacgtgaaattaaactgtgtaatcttaattgagtgagatggtagttttgcctggagccactagtaaatctgtacttctccaagtgttaattagtgagtctgtattcaattttgctcagagaacatttgaagcactcaatatttaatttcttattatacaatgtctgttgctagaatcttgtacctgcgtcttagacacatgcatgttgttcatcctcagctccagaaaaacacaaccttaactaacatacataagaatattatatgctgtttatttttcaaatgaggtagttaattgttttaagttagattgtgctattttgaaaagaagggattccgtaagaggttacagtacattcagagtacttaaaatttatttctactatattttcttgaataattactataagttggcattttctatgtgctgtcttttataaatatctcccaaacttcattttatctctgctttataaatgagaaaattaaagattcaaagaagtgaatctgttcaacatcatctaacctgtaagttctaagctccaggatatgaacttcaaaacttatactccttaccacatgttatgcacttataactgtgggtttgttactcgctgtagacagttagtaaatgtgaattaagtcagattttttttaaatccctgctccattaactcccctttcaattatttctattttcaatagtatgcttcctattattttccagatgaaaaagtcctttaaatattttttaacaatgtaaaacagatgggcaattccttgagacttgggtctccaaaattgtagctgacgtattttactttgtgtttatttatttgtctactaaatatgtttttgctgggaaaaaaggtctgtccatagtgatataaaatcactctccctagatgatttcattacatatttgatccaacagagaaatttcgggtcttgatacatttcacttgggaaggtacatagccaatatctgattccctctcaattttttttgttgttgttaaatattttctaaacaagtatttttttaattaagtctcaaacagctacttctcaaaattccattcctttctgagctctatagaggaaagatatgataggatctataaacctaaataagcaaacagccattagaaatcttaaagatggattgtattgatgataatatagacacctatacaccacgctccattgactaatgagaatgttataataggaagtgcctcagacctctttgtgtgccaaaatgccagcccactgagaagttaacgttatggtcaatagtgtttgcaaccctccagaaagctccgtaaattgaacagactgttaaccttcacttaagctttcacatcagtctaacgggtgctctgtttgctgctgactgcccgctagagactcactcattgaaagatatgtagttcatcattcatcatttcacaaatttggttccaggaaaagactaaaaattaccctaggcacaagctgtttaatttccaccccctcacatgaatctaacaaacaaccaaaaatacaaacgacattgagtagaaaataagatgtaagttttggtgcctcagtgtcatataatgtaaaggtatttatgtgaaaataacagcttgccttgaagtttcttagtgtacataatattgcagagaataacccctttcacttttaacccacgttctcttaaacctctttctgatcctatttcctgactcttacttgctgcttgtagaagctcatgattctacaattttagatccaaccaaggcagcaagctcaaaattcacccccaaacacactctttcccctcacctaaccaattatatttcctatgcttaaggcatgtattttcagtaagcagttaaaaagacagcatgacttttttattaaaccctaaataatcatatatagcttttctggtttattaatgtatagaataattctgcagtggtagaaatttaacaggggaattttatccataactatcaatttcatactttacctagataaccagaattatgtgacttgtttgttgaaagtaacatgcgttgtatgacttgtttgttttttattgaagtttgcatctcaaatgataatttaaagtttttgttagtgaaagtagggcagtgaccacacctttatataactattattaccttgattaattgctacattgtaaaagaaaatattttctacaattacagaatcctcagaacaactctgaaaacaaatgaggtattatccccaattaaaaaaaaaaaaaagattcaagagatttagtaagtacttcggcaagatctaaatatatggaagcaaattagaaacaaaccacatttttctgagctcaaagcccaaactattttctgcctatttcattatttcttctttcctggcccacactcctgtaagtgtatgtttcgtcttaatatatgatgtttgctttattaagtgcttgtaatgaagaatgcttgtcaattgagatcatatttaggaaatgttagaattgctgatttgttttgtgataaatattattaaaatgtaagctcaaggtaagctggatattttgtacgttttcatcaaagctttatccccattacctaggtcagtctgtgcctggaaaatagcagtgggtagttaataaatgctgaataaatgggatgtttagatacatttggccaagcgacactctcacctcaaatttgtgtgaaaaatcaccccaagaaataaaaggcaattagagacaattgaaaaattaattcagctgatagaaccacttgtcaaatattacataattcagaacaatatgactgaatcatgatgaaggctaaaattctgggtcttaagcaactttaaacctttcaaggaaaggctgattgacaaacacaccttctgtgtttaatcaatgccacaaaacatacggacccaagaattggtggaaatctagactcatcttcagaatggtaaattattcttgagttataaggcctccattgcctaagtgactaaaatgtatgtttccagaaagatttagcattttcctacaggttattatatgcaagaaatgcctttctccaacaggtgatagaaaggtcagaatcagccatctcctaagatactttattttattttgttatattgcaataatatgcaatgcttcagtgttataccaatgaaataaaatgataaattataatagcagtagctgagctttccaagattatacaaattaggtttagaattgaaattttatgaaaacaataatattttaactgcggatagaatattgaaagtgacctatgctgagagaaaaaggagaaaatttaggttacaaaaatatcagatgcattaatccaacataattttgtaaaatggttatcaaaggtcaacactcaatgtaatgtattataataaacaagaaaatgatggccatttttagcaaaaaaaaaaaggattatttgaataatccaattttattttacttagagacatttttcatataaaattagaatgaaatttatgttttaagctactttaatcatacatttttgttgttgaacaggatgctaaggtacagaggaaatcatgcttccaagttgattgccaaataatagtagcattgtctaaactcaactagaaattttgtcaatgcttttttttcttattgcccaaaatgatgcagtgagaattgataagataaggatattctgaccacgaggagtttacaatctagaaatgtggtcatatgcataaatagctgtaatacaataatgactatggcaacagtgaagaacaaaagagtgatctggcaataagaaaaaataagatttctgttccctctaaagaagccctttctagaactctagtgaaagttaatgggtaatcaatctaccatcacaagttaatgggtaatcaatctaccatcacagaaaaagtctagtctggagtgggtgacttcaagaaaaggtttccccatagcaaaatcaagtgtaactttccaaaggctttgagattatattttcacatctgtttttgtcgtttgcatgcatatagaatcacacatttatctctttctgttactgtgctatattacacaaaaacaactggttgggttttctcaagaggatattttggggtgacctgagttaaaatagaggttatatcatcatttaaattcactttgggcagccttagaagacaccccaaagacataggctatcatcctagagaatgctataactgctgataataagggacgtgccatagatattaagatgctaccgggagggaaaataaacagtgatttataacgcaagccctgatttgaaagtcacaaggtcagacacttggaattgcaggtgttgatttgtgatcaagaggtttttcacatggacaactctagaaagccttatgcagagtgagtaacagcacaaaggtactactagaatattggcaaaaattaacccaagcaatgcagagaccagatcactctgaatgtgtttctattttcatagatttcacctagtatatttaggttaaagaataaggcacaatgaaccttccctatctctaaaaaggaaaagaaattttttttgctttcattatcacttttctaaatactgagcagctcgttagtatcctcactctgatctataaatataaatataatattaatatatttatgatattaagtataaatattaaatatagccgtattaatatatctataatatttaatatataatactcattaatagataacgaggcaacactatggcattttgttccctatgttttaatatcttggagatggttatcttgtagtatgttgcagaaatgcgttatccccatgagagcctttggaatgtgatgacaaccatagtgtgggagccgacagagtcactgcttaggtgggaaatgtctaatagaaagaaaagaaaacttagaacatagctttgaggatcttgtattgaaggatggagaagacagcaatctgagaaagtgaccaaaaatatccaggagaaatactgggaggagtgtagggtcctggaagtgaaggaaagagaacgtctcatgaaagaaagggaagcgaggcacagtggatggaggcagctgttggaaacaccacttgaattacttgattgtagttcaatcagttttcaaaccccagtgagggaaaacctgagatgtctgtgggttgaggagggaatgaagttgagcatgagaatctgaagggagaaggaaggcaacgacggctcacagattcctcatcaccaaaggaggggaggtggatcagggaaggtttgggcttagctttttaacacaccattgcagctatttttaagacaaatgtaagaaactcagaacaagagatcgcttataaaataattgaaaaaatacatagtttaaatcagttcttataaaacattgaggtgacaagattaatataggtcttgttacatttttatttttccattgttaagtgtaatgcaatttatataaatatcagtttcctttagcattacttttgcatgaccttagctctatgctttattcatatatgctatttcatataaatgatataaccctttgaaattcaatttagaaaaataccctaaagatattgtgagccatatttatacacagttgtataacactctccttgtactagagctggttttacataacgatttgggattgagttccttttttatgaatgcatttttgaatgccacttctcttgtaggcaagtgtatgggtattgtatatttgtccctgatgtagattataaatctagatttataaggcatcattaggcctagcagcccaagttttcatatctatttcttcaagacaaaatatttcaacattactaataaatcatgaaaagtactaacataaggagactgaaataatttgttaaatgttatttttcaaagtaaaacaatttcactcctaggctttagagtcaggaaaacaaacaaacaaacaacaaacattgtttaaaattatgggttcttccatgttacactgatactaccatatgacaccccgagcttcagttttcttatctgtataatgtggacaatcatcattgcaccgaaagaattcagtcaatgctaatagagtgcctagcgcataggaaaactgtcagaagggtacctttagctgcaagtaatggaaaccccacttaagtctagcttaaacaactaggaaatttatttgctgacataatttggaacatgagctggggaaacagtcatgattgatttaaggagtccactttcctttccacagtggtgcattcctttatttgcttgttgtctttggggtaccccttttatgttggctagttacagaaatctacattcacatcctcgcactacatcattcatcagaagagagtgcattatttccataagctctcttgttgtagtaaggaagctttttcttccagaagccggccctgcccctacatttcccctgtgtctcagtggcctgaccgtgctcacttctgaagcaatcctaatggctaggagaaagccaagggcctattggccaatgttcttaaaccaattattgcaaaggttatgggattatccttagggtcacttttggggttgtaggctgggtcagattcttatgtatcactgtatgaagaagggaatgatactcaaaaatattagagttaaattttgaataatagtagggcactgatgaggcatcaaagtgacacctatatttaacctgtttggggccctattccttcacaccaaagaaggaaaccaaagcataagtcccatctgagccaattcagttcatgcgttgaatcacaatatgttggtggtcctaaaattattggcccaaagttgagtatcttggtgttttgttttgttttgttttgttttgttttgttttgttttttcggagtcccactctatcgccagactggagtgcagtggcacgatctcggctcactgcaacctctgactccctggttcaagccattttcctgcctcagtctcccgagtagctgggattacaggcacatgccaccacacctggctaatttttgtatttttagtagagaccaggtttcaccatgttgtccaggagggtttcgatctcctgacctcgtgatccacccacctccgcctcccaaagtgctgggattacaggtgtgagctaccgcacccggcctaaacctgagtatctttgctctctatcattcccattttcagcacccgagccttaaataaggtaatggaataaaatgaaaaacttgtgcaaatgctttacaacatagttaggtaagtttatctgaaaagataaactaatttcctatatatgactttgttacattattctcctatgagtgtcaagttattttaagaattcagagttacctattaaaaataaaattgacgagttatcaaaataggcctagaaatttagaacatggctaaaactcatctgtacgaaagaaggaaggaaggaaggaaagaaagaagaaagaaagaaaaagaaagaaggaaagaaagaaaggaaagaaagaaagggaaagaaggggagggaaggaaggaaggagggagggagggaaggaatgagagagagagagaaagaagagagaaaaacaaagaattggggtggtcgtgtgcacctatagtcccagctactcaggaggctgaagtaggaggattacttgtgcttgagaggtggaggttgcagtgaaccatgatgatgccactgaactccagcctgggtgacaaagtgaggccctgtctcaaaaaaacaacaacaacaaaacaaaacaaacaaaagaaaacaaagcaaaattacaagctgtaatttcacacctgtggtatattttattttgcttaaacaatatgctttaataaatatatattgaaatgacagaaaaataatattttaaaatgtatctgggtctacacattaagatttagtttgcagtattccaaacatcatttaatggaattaaataaaatttccaaatttataaactaaagaagtgctgctttcttatgaattcccactctaaattcattaatttaagatacatgtggcctttctttgtaactttaatatttaaggaaaattcagaatacttagcctcatccttaatcaaagtgtaataaattacaaaccccaccaaaatctctacctactgaaaacttctaaaggtaggagagagtatagagcctacagctgactccctacaatattctacatagcaaagtgaattaatattaggcttaacataaagcatctgttttctaccattgacatttacacacacatacacacacactcccccacacatatagagtttgttagggttcaccaaaggtaattaaccatcagatgtatattaatcacacacacataaacatgcacacatatgtattaactaacacacacacatttacaacaaaatagtagacagaaaaccattataagtgcagtttggtaactttaaggacctttgatgagaaatttcaaagttggtgacagttcatatgaggaagggtttttcctctgacaatcagatgagctaattaatcagcatttgacccggctggatcttagccagcctaactgttaatgagtgtgcactgttttgccagcaagagcacagtctcttcaaaaaataattgtcagggtcatttttgctatgaacaaaatcttattttgaaatgtgctagacttttttaaagcaacaataagaatgacacgatcattcttaaatatttcttattaaatattatggtaccaccaaacatgagcattgttttatttttttttttttaacaaactcattgctcttcatttatagttttacattttaaagtcatatgatgagaactatttcttccagtttgctttctgctgccaccagacttgataccacaaaaggtgtctgggtgcatgcctgtgatgatattgccaggccgttcctttcttggggcctgtgtatacatgggcctgcctttttattagcacctattataatatatggccattaattattagctgtacatattttctactagactgtcagctccttggaggtacaaaacttatttttctcatttgtacagcctctccgatatcttttatcaacttcatgtaatcctgatagctcagtgaggaactgaggagtggggtcccctaagaaggacataagtctaatttttaaagactaggtgtagggctgcagcttggctctcagctgtgtatgattccaaacaccgaagtatctccacgtcatcaccttttaatcacattttagtgtgatttataagcacatatttggaataccaccacaaacacacacatacaaatgtcattgttatttatatgcacgtatgatggtaatatatatgtctgcaagtttgtgtgtgtttgattaatatacatctggtgattaattttctttttcatttttttttgagacggaattttgccctaatcagccaggctagagtgcaatgtcatgatctcagctcactgcaacctccacctcccatgttcaagcgattctcctgcctcagcctcctgagtagcctccggattacaggtgcacgccaccatgcctggctaatttttatgtttagtagagatgggggtttcaccatgttggccaggctagtcttgaactcctgacctcaggtgatctgcccacctcagcctcctaaagtgctgggattacaggtgtgagccactgcgcccggcctgatgattaattttcaaacaaaccgtgtgtgtatgtgtgtgtgtgtgtgtgtgtgtgtgtaaatgtcaatggtattagaaaatagatgctttacattaagcctgctatggattcacgttgccatatagaatattgtagggagtcagctgtaggctctatactctctcccaccttcagaagttttcagtaggtagagattttggtgtggtttgtaatttattacactttgattaaggatgaggttaagtattctgaattttcttcaactttaaagtacaaagcccacatatatcttaaattaatgaatttagagtgggaattcataagagagcagcacttcttctttagtttataaatttggaaattgtaattaattccattacatgatctttggaatactgaaaactaaatcttcatgtgtagactgagatacaactttttaaaatatttttctgtcatttcaaaatatatttattaaattaaaatacagtctttaaacaaaacaaaatataccacaggtgtgaaattacagcttattatatgtatttttttttttttaaatttactctgtcaatcaggctgaggtgcagtggcattatcactgctcattgcagtctcgacctccccaagctcaggtgatcttcgtaccttagcctcctgagtagctgggactacgagtgtatgccaccacacctggctattttttaaaaatgttggtagaggtaggattttgccctgttgcccaggctggtttccaacttgtgggctcaagctatcggccggcctgtgcctcccaaaatgctggggttacaggtgtgagccactgtgcctggcccacatatgaaattttgaaccaacaatcttctgagctctttttatagaaattgatgtaagatcacaattatttagtgatctgatatattttagctgctgtctataatatttggaaaggatctgcaatattaaactgctttacatttcagttataaaaaaaaagttaaaatttcatgtcactataattattacaggtcacctcattcactgtctttccttttccttagcatccttagatagccacagaacatttccttaaacatttcttgttacttatttcacatactcacaagttcccccattccatttctagaaagcttttggaatgttttataaaacagtatgagcattattgctgtaagaatgctattgaaagtggagtgtaggtaggcttactatacaaagtggagtgtaggtaggcttactataaaaaacaaggtatactaaaacactcactgctataaaaaacaagcctcaaagacacatgcacatgtacgtttattgcagcactattcacaatagcaaagacttggaaccaacccaaatgcccatcagtaatagactggataaagaaaatgtggcacgtgtacaccatggaatactatgcagccataaaaaaggatgagttcatgtcctttgcagggacatggaagaagctgcaaactatcattctcagcaaactaacacaggaacagaaaactaaacactgcatgttctcactcataactgggagttgaacagtgagaacacatggacacagggaggggaacatcacacattggggcctgttggggtttgggggataggggagggatagtattaggagaaatacctaatgcagatgatggattgatgagtgcagcaaaccaccatggcacgtgtatacttatgtaacaaacctgcacgttctgcacatgtatcccagaatgtagagtataaaaaaaaaagcccccaaatatataatggaatgttgcaatgtaagtttatgtgttattcaagtgagattaaaaatgtgtgttcctggtttgcagaaggcaccctccacatgatagaggaagcagagttttcctttggttcctctgcatccacatagtataccaggaagagaaagaatagaatagagcacaaaagagattttcatgagcttttgtagaaaaagcctgagcccctttcactcacattactttggccagaactcagtcttctgactctgtctacggaggaatgaattttagctgtgtgccaggaggaaagaagaacaggttcatattagctttccggcttcgttgtcttctcacattttgttcccaccacattgacttttctgtttgttcgtttgttttgttttgtttccagaaggcactacagggtcatgccacaagttgtttcttctacaaggaatgcggaatgcttcccactttatgcaggttacccagctgacttctatttttcatttaaaactcaattcaaatatttagttatcaggaatgtctgctctaatatgatacatattattattcataacacacaatttcaacatcagtgagaatttttttgatgaatgtttatctcccgaagtagactgcaagtttttaatgacaatgatcatgcctgtccaccctccattattacacagctcctatcaaagtcaatagaatatgaaattatgtttttaattaatgaaagaaaactccaccctccaactcttaatgacagtacaggttgagcatacctaatccaaaaatctgaaattcaaaatgcttccaaatccaaaactatttgagtgccaccatgacatcacaagtggaaaattccacactggaccttgtgtgataggccgaagttaaaacacagatgcacaacacaccatttattcagcatccccaaagacaaagagattctctcagcctccctgagctgtgatatgtttctgtgcatgcccaggtttccccatgcaatcacgcccacaaatggtatcacacagcatggtaggcagagactgaaagcttgccattcttgattgttgctgttctttaacagctgatacaggtattctggtgatgctactgtgttagtcagttatcctggacacattgttttttcttatattaatggtatgttagatttttttactgttaagttctgacatgtgactaagcataagaaaatgcttgcttattggtagcatataaattcagagtcaggaatgatagtgagagaaaacaaccacagagaaaacagtccacaggtgtggctgagatagtgatgcctctgctttctgatggtgcaatgtatacaagctttgtttcatgcacaaattatttaaagtgttacataaaattaccttcaggctgtgtgtatatggtatatataaagcataaatgatttctatgtttatacttgaattcaatccccaagatatttaattatgtatatacaaatattccaaaatctgaaacactttttgtcccaagcatttcggatgagggatactcagcctgtactcccatacaatgaggccttaaccacagaagaaaacaataggttcttcaaagaaattggttgtgacatttaaagggtcaaaatgggtggtaaatgtggaataataattgagaaatgtaaaataattgagaaaatagccaagaatacctgagtatgaaaatagatgtgaaattttagcagtctatcaataaaatcttgatcaaacaccacttattcagctgccatatatgagtgtcaatgaggagactgtagagcagttagcatgatttttacattcagtttattaggtagaagaaaccctgcatccattgtcaacattcattctgaatgcaatgtcactatctattttattggcttctttttcccaatgcaatatttgtgatgaagtgttccccaagttatgcttttatcttctttgtgtccatctaattctttgtgggtgatgtccactactctgacagcatcacctatcataaaatgctctggatctataattccagtcctgcctgagtcctgtttctgcattttctttgctgatctttactcaaagatgctctgaattcctctgaaacttaacctgcctcaaattaaatttaggataagacttctccttttcaatatccttctcctccagtattctctgtgttaattcagagtatcaccatccatcagttatcaaagccaaaagagtcatttttcatttcctctgacccatttgccatgaccaagagaagaaagagcttcagctcctgagcctaggatgtctgtttttgccaattatgccaatccaaatccggctgtcatgaaacctggatggaaaaaacaaagccagtgccagctctgttcagtaggatggaaaatctctgtggcttggtagcctcccaggttcctacagagaaggttcattctgagatgaggatctctgtggcatatggtcttcaggaggagaatatctatgagaaaagagtctccctaaaccagaaaaatgagaaatgcaaagaagatctggacaaggcagtggtggaagtgtcccctttagatatttggttagtgctggcattactgcctgtggaccagatggtcccaaagttactacacactgcactgtatgcctgcctgctttcctgcctgctccagagtctactgagaagctgtattatttgtggatgtatgtgacacagtctctgcactgtagttataagccatgtgtcgctccaattcctaagaatccagtcattccagagattactcctcatacatgaaaatcctccagattcctactttctgataaagaaatattattgtgaacagatcagaaccaatgtaggaattcaacctcaagttcaaaaaaatcatcttctagatcaaaatgaggaaagactgcaatttaccattcaaggcaaaaatatccatatattgtaccagacacctattaacttcaataaggatggtcccaggttcaagagtgaggagaagagacccacagccagtgaatgaaacatggggtttatttgatggggacatacgggacagtccagtggtggcaggctggacagaaccgctacagcttgcaaactgcatgcagtttatgtagcattttcacttagcaccctctccttagcaacctccaggttaacaattcatttcttaagttgttattgctttcaggtatgtctgccatacagggtcgttctcggggtatgcttaagttattgctgtcaggtacatctctcataaaccatagtaatccagaccaagactgctcccttccacaggccaaaacctccaacttcatctttctctgtcccttgcaggggtatagttaccctgtttactatgtttattattattattattaatattattattattatttatccctgactggtgataccctgaaagtcttcccacctgagagcttggttattgcttccaaccccgggtgaacccctaagctagaccagtccgttagtgaccagattccagtgaagaagggggcagttggcttgcatatatggttcatgttgaaccagcccttcatgttcctggagctcccactaaggggatggagaagggatcaggaaagagggttgaatgaagaagagaaacacgtataaatgtaaaaacatgcatctgagaaaagaatcttagccccgttcttaaattcagaactctatttttgtgcttttaaacctgtcagtcctcagcgtcactccctccaccactgccatctcagccctgaagcttcctggtttcttcacagaacaaagatcagtacttggaatgtggcaagtactcattaaatgttttggattgtgcaaaacagtcacaatcaattggtacctctctattaatgctcccccacctctgtatctctgctcatgctatttctcatttgcaatgctcatccctccttatttctcctttgaagttttattaatctcaactgaaaaaaggttttcttcttgaccaaactccaatcaggcttccctgaactctttttcaactaggcctgacttttagacgcctgtgtttgtgtgcattgtctaattgcagtaagaatcttgcagagttggtttaattttagcaagactcttgcagagttagtttagccaggttctcccatgcttcatatctgatcaccatcaatatctaattgggttccccaccctccactatcctccaggtgatgtgaagggaatgatatctgatgaccctggcctgtcttcagcaagaatcctcataggttagtttaaacagaattcctccttacttctaatgtttcttctaagtaattttccatccactgactcacatcgtgctttttggctgtaattccccctcattcatgctgtatcaggaattgaacccagttctgttctgaggtcccttttaccctattgcaataatactgaatagaatctgtttctattgccttaactaccgtccagttctaatgttatttgatacaataatccatcttgtcatgttccatatgtagccttccaggcttttccagatgagcctggcttggtaatcattatctcttctaggatcttacagctctatttggtgtttgcacgtctattactttattctataactgattttcttactagtgtttacacacacacacacacacacacacttttcataaatgtgactccctataacccaatatacattttggtatatttggatcattgagtaaatacattaaactttttgttttcttttttgtctcaaaaacttacaaatcatctggcttttaggaggtgatttgtacacaaattacataaaaagtgaatttctttcatggtgttaactgttgagaaaatcttacgccaaccttttcaggagccatggtggttccgagatgctttaaaaataaattaccaatcctctgtaattttgcgtcctctcatctcacctactcataataaatgaagagaagatatgtcatgcctcacaggcaatcatatactgataaatatttaatgactggctctcaaaaaatattaaaaataccaatttgtagtgtttgctgatttttatgatataaatacacccaccatgacagatgcctaattaccaacatgacaacgctgaccctggagttaggaagaggtgtgtagtgacacatcatcatatctttaccatccatatatgatagctgtgaataaactcgaggacataagtcatagtaaaatccaatttttaatgatggatatgtttaaccactggcttgaaacttcctgatatttaattataagctctcaaccactgtgtgggttggctccagcacatcagaaaaatggattgcagcatattcagattatataatcactctcagtagcataacaaggatattacttggcataaaaatttcataaattgattatagacccgtgttatcaagaaacatactctatatattatttcatcactagtgttccttgaaactgaattttacaaggttctaacattgtcacatgcctcaaatcatcctccaaagatactaataatctagttattgagttatataaatgtataaggaaggtacgtgggaaaaatatataatagtatgaatacatggaattatgttgatcatgaccattattccttaagaggaatattatattttcagaaagatttgaagaacttaaagcttatacctccagtggcccactaattcacagtctaaaatgacagaacatgataaatttcaatatcttatacaatttctcatagcctctggcaggagcaattcttgaaacagtaggtggaaatatactcattaagctgcaaaattgcctatattcaggacacctgccaagcaagcattccctaaattaccacctgttaccataacatcaaagacatccaaaatacttgcttactaaatctagtctccctaagtatatataattttcctataatgctgcttgatggtagagcagtatcttaatttcatatacataaatcaaagttgtttctggacagctagggctcgaacctggttttcaacagctattcctgaggtatagttgatctttagtgttctatttgatgttgagttatagtcacactttttaacttgtccaggtgtaaatggtagttgctgaggcctttatataaagcaaatttactatcactgatacatgaaagaaaatcattttactgatattgtagcactgaaagttgtcaatggattatctaagatgattagaagctgtggataaattagtagtaggccaatatattttgcttgagatcatgtgtcaatatagcagcatgctccggagcagacatctataactaataatcatataaattctgctatatatgtctatagtcagtctatccacatagattttcagtcactgttacattcagtaaatagaatgtaacaatatcatgtggaaacttggttagataattctgcaagacatatcaaatggatgagtgataagaggaaaccaactgctttatgacaagctgaggtggagtgaattggtacaaggacacccagaagcacaatgtcaggtgatgaaaaggctgtgtaataatgagaggaaacagtaataggagaagaggaaataattagcaatcagaaacatcgtgattagaagagtgcataggttatgagctgatgaggctaagccctaaacaccaccactttttaataaatgtgcctacattattacccaaaaagagttctttcaaagaatttttggccacattcacccccccagcctccaagaaagagagagatagaagggagacagagagagagagagagagagagagagagagagagagagagagagaaattgttgaggggctaatgtgagccatggtggttttattcatcactataacagtagtttagagactacaggttcaggggccagacagcatggattcgaaagtgagcaatatcatttcttttgtgaccttaggcaagtgacttaaactctttatatctctgtttcctcatttgtgaaatgctgattgaaatgatatcatatttcataaggacattgtgagggttaaatggaataatgcaaagaaagcccttggcactgcctactgtgatgaaactgttccaaaaagtcagctattattttcatccccactgcctaatatgtagggtgtcagtaaccgtaaataaatgttgaggttgaatgaattcacattaccatccaagatactttcaaaaataaccaggaaaaaaggcatacatccctttagaggaagatgaagaaaaatgttattgcagcacgggagagcactgtattcttattaaggagtttatgttctggatagaacttcataggaggcatggcattgatcatcactggtcttttatcatcattatcattatagtttggtggccgttgttggcataaatcaaaatcatagaattgtagatttggatgagagtgtaaaggttatttagtgtgctttactataatacgatcatctgctataatatccgtgagcatgtcacctctggtcacgtatccacagagaataatctcattgttggctttagaaataaaataaatacctgagagtccataatggcaattttaaaaaaatgaatacattgagcataaccacaagcataaattatatggcttaattattttgacacgcacacacatacacaggcacatgtataagttttatatatagaagtatatataaatgtaatatttgccctttcttggtgctttacataatactcatgcactgtttcactaatcctttgtcttcccagaaccttagttatatttagcaatgttatttcacaatttacaaaagaaacacaacttattttgactccgacattatggacatttctggggatactgctttttggattgagttctaaagttggacataaataattagatcaacattgtggagaaaatatactataatttaaattttacgttgttatttttattaatgtgggtacaataaaataataaacatgacagcattaattaaactatgaaatagcatctcacaaaattgctaaaattataacaatcagcaaaatcctctctactccgaacctcttctcctagagtcacatgcatcttttggctcctgtttctcctctgaagaacactgcagccttacaaggtcataactgtttcacctcctttaaacttccaggcatacgcatgctcctctcttcagtcacactcacttggataaacctcagctcacaccaaatccagtccctgcctactctgtttaatcatggaggcaactaagtcaggctggagaaaaacatgcaactttgatgacttgtctcactgtgtttcacgaccattgaattaaatgggctgtttctgctgtctgggcaccatcccattcataaactccagatgtcaacacagcaattgtctcttcttttttctgtttctcgattttacctttctactctatcacttccatcgtcataataacatgctgttatttttcctttcaaataagaataaaaaaaaggaatctcgatctgacaggctagttgagttcctgcctatttctctgcacgtcttttggtagatctcctggagagttattttttatactcactgtctgtactgtttcctgctgcaattatgttttgaacacctcaagtttagcttttgtgctcactactctatcaaaatatgtcttgtcagtgttaccaatggttttcacatggctcagtccaacagtcaattcacattcctcatttatggacctatcagaaacatttaacacagttgtcctttttttctggaatacttttgcttggcctctggaaccccttccctatccacttctttactgtctcattggctggaacttcttttcctctaaaaattagagcgcctcagattttctttctcaaacttctctatgtaaatcactctttaggtgatctcactcagcatcatggctctaaatattatttatattctgaggaaaaaaatacatagatacctttactcagaactgtttcccaaactccacattttcaaatccagacttcattttctccacttcagtgatgtaaattctcaaatggagaatgcactaaatgcactaaaaatgaaaatccttccaattccccaaaagcctctttgttccagttccccatctcattaactgacaattccaaccttttagctttggtcaaaaatattggagtcagtcatttttttcccttcactccttactttccctgtcatataaaaaataactaatcaaaatatatgttgtctctgccttcaagatatgtctagaatctaattacttttgcactaccaccattgggcaagccattttctcttacctaaattattgcaataacttgctacctgttttctcttcttctgccttgaacccatgaataatctatgctcaatctactagctaaaataatcattcaatattagagacacattgtgtctcttctctactcaaagccctctaattgttttctgtcaaagccctccaattattttctgtctcactcataataaaagccacaggttatacaatgcctcctataagtctaacatggtctgggatcccgtatttcctctctgatctcattgtgttctactcttcttcttgctaggcatattctacctgtgcctagaactatccactttccttcctccttttatgtctatacctaaatatatccaccaatcaggccatttccctgatcatcttatagataaaaatctgaactccctttttccccgccgcccataattcttctcctccttatattatgctttaatgtattccagcgctcacaacacttggcttaccatcagctttttggttgcttgtgtgagccctctcacacaaagtttagatagctatagagacagagagccagaaagacgacagacagagatagatagatagatagatagatagatagatagatagatctctagttttatgtactactgcatcgtttgtgcttacaatgcctagaatataagacactaaattttttgaatgaaatacttaagaaattaattatgtactctatgcttttgatggcattctgtaaaactatgtgtaaaatgttgatttatagagatttatatttcccgttaatttccgttatgctttctgaaacatgtttctctggggagtgaaatgaccttaaacatacttaagggttagtctaacatttatctttgagagcattttctcttcggaagctggccacctagacacattaatttttcccacacaatactggttaaagaggtatttcagtggctagcgatcctcaaccattcgtaagcaacactccataatagtcagttttcaggagcaggaaaatgaaggctaatcctagggcacccatgatacctggctgtgctaagtagcaaaattacgggcattttcttttcattacaactcacgtactgcaaatatgttatctgcattttgacattaaattatattgccacataaaatatgtttaaataatcttatttttgttctcattagtacccaacttaaaaatacttacaaaatagttaataataaatactttaaaaagacgttttaaaataaataaaaataaacactttaaaatcgctcacaaagcactactttcatttccgatgcattttttctccattttttgcacacataatcatattctaaaaggtgaggtggaaagagttactggtcctaaaatatctgtttgtaatgttttgattatacttgtgctttgggtgtgtacacgtttacatatatgcatatatgtgtgtttgtatccaggcatgcgtatgtattctgtacctttttagtacttgtattgttgcatcgctgaatacacaatataatttttacttatcctttttatgacccatttgacctccatgagaaaacatgtggcatattcccttattcatctatgcatttccaaaacctagcttagtacttgacatataatagctggtcagtaaatttgctttattttatactgaaatatattgctctaagccagattttcacaaattgttatgagagatatagtaattctgcaatatgtgagtaataatattctagggtttcacatacagaataatctgaataatgaactccctcttgggatgctgtaatgttcattaacataattatactctctaagaaactaaaaattaccaacaaaaggcaatcgttttaacactgcttaagatataaacaactaattttcccatttccttttttaaatatatctcccctgatatcttaattttagaagcagattgcattatgataaatacttacagagtgactagaatattgtttggcatagatctaggttgataatgacattaatgaactttgcaaaccgagttcaattccagaaatgggtactgtacttttctgagaaattgctatctcatgtggcagataacttatatatatgaaaaagtatagtaagaaatttgaggaattttgacttaaatgtgtgaagaatttttataattgctgtgcctacagtgaaaatggctattttgtcacctaaacagtcagggagaacttggaaatgtgaaagtccttaaaattctactgcttactgtagtctcagtatgaaataatgtaattatgtttacttgtaagttatcctatggttgcagataggaagactcgatactataaatatgtcaattcttcctatatcaatccatatttatgttaatataaaagtaaaaaataagccaacagtgtgtttgaacaaaataagcttattttagagtttatatgataaaagaagtatgcaaaaaaatctgcgaaattatgttgaagaaaaacaacatgggagagctagctctataagatattaaaacatataaagtctcaataaatagaacagtatgatactggttcaaagaaacaaaacaggaatatgtgcaaatacataggaaaaattattatacataggaaatggtatgaatgcaaaaaaagtagaagaattaagttgactccatataccatttcttatacaggcaaaattccaagaaaataaaagatctaaatgaactaaagtggtagcaattagaagagtgaatataattttaaagaaagtaaaaaaaataaataaataaagattgaacccaaatggatgtacaaagcattcaaaacaagaatccacaaaaacttgtaggtaaagacaaatgttttattttgggaataatgcagaaaatggtatcaaaattgacttgagttaaataatcaatttgaagttgtggaaacctgaggatgtcatatgctcagtatgaaaactgggtttgatgttagggaaagatgtatgttaatttgcacggagacccttaagattatatgcggctatagagggaaatgtggctatgatcttaaggatgagtttttggcggcatccactgaaaagatgtaaaaagtaggagagtaacttgagtgcatagactaggcatgtcaagacctcaagggaagaggtagtttgaagaatttattaggtgatcaacagcatctaatgttgcaataggtgtttattcatacagagtaagataagagatagaaagacagcaaaggaaagaacatgcagggatattgcttctaagttttccactatgactttcaatgatcttcaatttccatttccacaaagaatgtttacttgatatttaaaaggaaattaattgtaggcatctcttatttcctttgtattttaatgagtcatcatttcaaaacttttgtcacatgtcagtgttaaatatgacataactacgttgcccttgatactagttaaaattaaattttttactgattggaaaatacacatagtgatttatttcagagggtaaaaaatattatactaaagtctattaagaatcagttgtgctaggagtctccttcaatgtgtttcaaatatttggtgtgttccaaattaagacagagtggagaacgaaaactttcaagtttgaaacaccaaagattgtataggatgggggagaccaaatactattaaaattcaccagggtcattctatcttggaggtctcttaggaatccatgttccatctcttccgttattcccagataacagcatgattttgccattgtcttcaatttccagatgcattagaagtgtggcaagatacaattagagtgtgtaacttaaatgctagtaagacctattcaagcaagcatagggctctgcacttacagaaatgtacaagtaaatctaatttactaaaatatatttagtacatgtaaatttaaaatattgcgatagctgggcgaggtggctcacgcctgtaatcccagcactttgggagaccaaggcgggcggatcatgaggtcaggagatcgagaccatcctggctaacagggtgaaaccccgtctctactaaaaatacaaaacattagccgggcgtggtggcgggcgcctgtagtcccagctactcgaaaggctgaggcaggagaatggtgtgaacccaggaggcggaacttgcagtgagccgagaccgcgccactgcactccagcctgggggacagagtgagactctgtctcaaaaaaaaaaaagatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaaccctaagccaaaagaacaaagctggaggaatcacactacctgacttcaaactatactacaaggctacagtaaccaaaacagcatggtactggtaccaaaacagagatatagatcaatggaacagaacacagccctcagaaataatgccacataactacaactatctgatctttgacaaacctgagaaaaacaagcaatggggaaaggattccctatttaataaatggtgctgggaaaactggctagccatatgtaggaagctgaaactggatccctcccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacagcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaatcatcattctcagtaaactatcgcagggacaaaaaaccaaacacctcatattctcactcataggtgggaattgaacaatgagatcacatggacacaggaaggggactatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaacaacaaaaaaaaaaagaaaaaaaaatactgcaatatcttcccgccttttacactgttttttaataattattttatatcctttctaaactgaaagttccatggacatagagactatgtcttgtttctttattgtattcatttcactgtatggctagaaactagggctggccattttgtgtattattgtacttgttccatatctcatattatcagatgattgatattattatcatcattgttttcattttaccaatgaggaaatggattcagagattaaacaccttgctctggatcaaacataactcttactctggaagccaaattcttagccacctcatggtgttgccctagtacctcaactgtattaatgcacttagtatagtcatgttatgcagaaaaaaggactctaagatggtggagggtctcagagccaagttatgtcactaatgaactacagatattcaatgtaaattcaggaagaaataagagaggtatgtaaactctcatgaatatttgaggtttgccatatcatggatgataataatcatgctgaagtattatttctgttagtattattattttaattattagcatttgaatccacaaaaagaagatagaatgaagtgtggtagatgtaacacattttaattcaatagtgagcatagttgaataactggcatagtgatacgactgatatgattcatctttactgctggtgactaggcagatagtagatgattatctgtctcgaatgctgttgaaaagtctaaaagtgctgagctaacttcttccaagtgttatgaatctatggaatttagtatagtgctcaacatttatcatgttgagaataagatttccattgacttgagaaaagtaaaacataatctataaggcaggaatatcagctgttgttattccctaaggtcaacttaaatgtaaacctctgatttacatagaacattaatatgtatgtatacatttttagaagcagatttgattgcagtcataaatttgctaaagtcctaaatgcattgttggcatccaaccatttactgttttggcataattattaatatacttactattattctgcctatgaatgtgaatgagtgtgatatcagaataattagaatgagtcatattataaatcctctgtccaactttgaattatattgtatgtatgcttgagcattatagatgtaaaaagtgacatgagttctacatggaatataatacaagtattacatcaagacattttcatgtagattattttagtagtcgtagaattttactacattgaaggaattgatattatgacatttttgataggcaaaccaagagtgaccctttcaaattgtacaatgtcaacttctatgaagaaagataattgaatattgttatttgttatttagaagattgaaaaatttcagtcatattgtcatagtctgttgattgattaagcctagccataagtctataacattcatttttatgttttgtctcttttgtatggttatgtggaatcgatgctattactttgacctccaatatttaattcaacaagcagaaatataaccttttcacttgacaaaacccacttattttgcttgagaaattataaaacaaaaccagcaggtgcctgagattcagtacttgaaattatcatttaaagcaaagtgtcttgtatggtttcaacattgttcactccattttctggcagctgacactcatttactctcaacaagtgaataagcagtcggtgagtgtccctgatgtcaaggagctgtcataatttccatggagttagctctgtttggcattacagaaattcactgtgatcctgctgacaactcttttgtatagtcataaagtatacagcagaacagtttgtcccagggctaaggtcaggctttttattttgctattatgagaaatcaataaatacacaatactatttatcttatttattctaaggaaggaggagaccaaggcatattttcctccttctaattcaaaatatttctaacattattattagattagtactgatgggtcagtcagtactacaggaaaacaaaatatgtagaaacagtgatagtctgtcaaagtttcgagctaatttcaaacagattgggtaacgtttgaatcttctatggaagcattccccaatgtttaatcttcaagatatctctgaatttatcttcatcagatgttggatatgtcccatgtgtccaatgatcacacttctgcttgacttccagccccagcccttgctcctctacctggagttgcttccacttcacacacgaatgggcatttaggctgccataacccaaactcaacgagcctaaaactagatgggccatcttttgtttttctttttaaaatttatgtttttattattattttttgagacagggtctttttctgtcacccagactggagtacagtggtgcaatcatggctcactgcattctcaatctcctgggctcaagcatttctcccacctaagcctgccaagtagctgggattacaggtgcatgcatcatatctcgctaattttttaaaatttttatagagttgggggtctcactatgttacctaggctggtctcgaatgcctgggctcaagcgatcctcctgcctctgccgcccaaagtgctgtgattacaaacatgagccaccgggcctggccttcaccatctttcttcttaaatcacttattaacttgggatttgtcacaattttatcatccaaacctaaaattttccctcatgtgcttccaaaatcttctgaatttacatattctcttaatattctccttcaagtttaccatgcctcagtccctttacttgctttaatggtatttattcctttcttcattttgtaaaaaggacacattcatttaaaggaagcagaaaatgcagaaagattaaaaggacataaaaaccccttgcaatgttatctatatttaagcattattaatatttggagctaaacttcatgttctccatcttttaatgttaaactaaacaaatactttataaagtatttcttgatcatggcagcaggatgcattctctttttcttgctgcctgtcaatatcacttgagtggcatatacagtcctattgaagatattcgtgcaaatatattgttcctttttccaggtttaaaactctttaaggccaaggcacatgcttatacatttctttgtttaagacagatctggtacagtgtataatgttaattcaatatttgttgaatgaatatgcttaataattcagatctatttgaattatcaccgtgaataaacaagtttaattctcttctatagaatgaaaatatgtgtgagtaagctggttaggaggaagtgaaattttttattcagttaataatgacaatacagattacatgcttcagtgaagcaaattcctttgtataaagtacaatacattgttgggttcacaattgcagagtcataagaaaatgtatttctcctcatatttctctcttacagaatgtaccattcaaaataattgatgtaagtataaagaattgtctttttgtgctactaaaatttccactacttattttcatttgtcttcccagcacttcttctgatcaattgtatatttttaaggcttttggtattcattgttgatattccatttcattttatatgttctatctctaacaatttcatcttttttgggggatgatctcccttttttctgtgtataattttaaatttcaaatttcactgtctcagcaacatgtagtgtacatacctcttactttctcctaaactagtcagattgcatcctattttttgcagaaataattcaaagtttttcctctttataaataaaattatttccaagttagggaaataaagacagaaatccagccatactaaataagtagtactatagaactgctttcccaagaccatgcatacttggagacactcaaggattatggcatttgtcagtccattttattactaggtctcaaaaatctcatttactatttcctacttcaaatgacccaagtttcttcacattgatcatctaagttttgcattctttggttagagtttcatcaaaaagcacctagtgttgcactcacatgcatcttattctgatgatcaggtggtattgttttgtcttcttctgtagtgagcattatcggtatttgcacccaccccatagctgcagtagtatttattcacatttctaattttaggattgtggaatttttttccatcacaaacaaataggattttatatttttcttccacatagtccaagggtcattctgaaaacaggatttctcatgtgtcaccccaatactgcactgttatagtattctgctgtgaatactgtgactactaattcactatatctacatttgaaaattgaaacatcagtctgtttgctgttcattttgtgacaaacttaaaacacttgagctttttgaaggtcttggtacatgaatttttatcatatacctaaaaacactcagatactactgctgagagattttgggccatggtagaggtgtttgtccaaaaatagaaaaaagtaattggttaagaaatatatacaagtaaacagaattatttctaggtaagttttattctactcaataatacaaaatgcactttgcatggcattgttgtgagatgtccattataggccttcctacatttgattagaaaaagttatcataattctagatagtataggaatcagctggagatttcttaggtctaactccagaccagtggttcacaaagcatgcttataagaccagaaacatcatcacctgagtacatggtagataagtaaataatggtctgcaccccagacacagcgaatcagaaactctgagggcagagctctgcaagctgtgattgaacaagtctcccaggtgagttccatgaacactaaaggctgaaactcggcgagaaccattgtttttaaccaattaaaatacaatcttcaggtgagtcatatacactgccaaaattgagaaagcttgagaatcaccgaataataataatcatcattttcaggtggtacttggtaaatttacaaacatgtaaacctgtgggatttgcctagccagtcacacatttattaggattattctcgtgtagtcgtctcctaggagagagcagagccctgggtgataggaaaggcttgaaacatgagcagcacccaaacagagtagttttggaagacttgacatggcaggaaaaaggtgcacatttgacaggtaaggagaacctgcatgttcggaacctaaatattactggctttgttgactttgtgtttgtgtgtgcaaatttggagtgcaatgggataatgctaaaaatgtggcaagaatgaaaatactagagcataatgtaggtagataatattaaggtcagaataaaggaaaaatatagggaattcagcattagtgaaagtagttaatttaatattctactatcatctcaaaatatgacaatattttaaatcccatttttgagacatgattgcactttcttcttaatagctcctcctctaataatcttgatttatatctatgcaaatctagacttctaatggttccggttgttttaaacatgtaatctggtctctgaactcaagtagttattctagatttagaaacagtgctagtcatctgttagcactttaacacgtaaacctatcctgaattggaatatgttttgaaaatgttccatccccagagtaattttgttcttgccttgagcccctggtgccccaatgctgtttatacattaatttagtctcttatatgcttaagaagaaagtatatgaatgcaaatgagaaagtcccaacctctgggatttgaatctgaaatttaaaacaagctaaaagagcatcagaaatggaagcaggattaccaataacatttatgatttaatgatttcaggaagcattaaaatgatagttgtgtatttataagcaaagccgtttatgtattttgcttttacttatttcatttttgagataaggcctcgctctgtcgccaaggctggggtgcagtggtgcaatcacagctcactcagcctctgcttcccttgctcagcttcctgagtagctagggctacaggcgaaccccattaggcccagctaatttttgctttatttttttgtcgatacagagtctcactatgttgcccagtctattctcaagcccctgggctcaaggaatcttcccccttcagcttcccaaagtgctgggattataggcgcgagccaccgcacctggtctattttgcttttaaagttaataaactactagtgttttagttggaaaaaaaattctctcatgttatttgtagaaatgctgtagaagaaaaaaatacataatattatataaaatttgctgccttttcacatgtgaaagtatttgaggtctaaaatcaggtatatctgagggcaaaaaggcaaagattcatggtcattgaaacaggaatcttaagagactgtatctacaaagaacatttcttgtatatgttgtagacactttagcagtaaaattttctattttgttctctgtctcttcagtgagaggtacccttattaaaactctgcaagggaatatataatttaaattacatattttggtataactttaggcaagctttatagtagtaatgcttttcacatgtattgtgccttcagactatcttgatattcaagtagatcagcttagcctggaaatccagtggaaatatggattgtccacaggccaaacagaaagtcttcttttgcaaaatcacatgcagacttttcaatattgaaaggatttgttcaaacttccagttctctgatgatatatacataacatataaaaggttatccttgtccatcgatgagtcaaggggataaatgtgtaactaacactatctacaataaaaatatttttgttacatcagattacagccccaagctttatttaaattgacaacaataggactcatgtaatagtgtcgtgaggattaaattagatttagaatctaaaaagtaaaaagagcctagaataatccctagtagatacgacaaacatttaataaaaatagttattactgttaacagatatgtgatttatattagtaatgtaaaatagcatactctctcatactcacatggaccttttttcttgttccatgcaatatgttaacagcaaaactagtttacaggtgagaatgacaagaagatgtgaaagattatttcagctttccctttctttaaaaagctagcatttcaagacataatttttttaaaaatgaaaattctaaattgttacttactttaaaagtatttaaaagagattctgccaatggtttaatataagaacaaaaaggagtatttttcaggaaatcaagccagagattatgagtatccattcttgttggcagaccttatttgcttattttaaaggcagtgagcaaaagatgtagaactccaagagacagacgttgattagaagtttttctttaagatgtcatttttattttctgaaaaagcatttatttttaaaacttggcacggattattaagacgggtacagcttaaatttcccattaaaaaatcatatgtcattcccaaacctgttcatatacacagagaaaaatacttaggtatgtactcattactttggcctttccttaatctgaaaaatttttttataaaactgagtatttttgtgatgttgctccatcagctcatttaaaaactactatatgatcttgttcaatgttgtttaatcttaggaccactttgtttcacttatagctctaacatctgtcttttttttttttttttgccacaaactcttttgtttctgtgtttagtagctatccatgctttttgtcctcccactcactaccaattgctctcaatatgatgacaatttaagagaattgtagcaagctaattgtcttccttatattttccctatctatagatttgtttactcaaggagctctatgagaagtgtcaggcatttgcagagacaaattgtcttggttgcatccaccactgttaaaacctccaatgtcacagggagacttgtctgtaatttctagagtcactactggaagtctttttatgaacacaggtcatcattgtggccacacaaaggctctggcactaaagaactctgatagacaatctataagaatgaagcttacattttggctaacagtcctttaatttcttatctccaaattttaagaaaattaagtcttcatgatttattcatcatacataacattttgttcatttgactttcatggtgatttttgattatagtaaaatccaacattcctatagaaatataattcaattaacatgtgttctaaaatattctaccatctacattattgagtaaacaaagataaatacattttatttaatccagtgtgtcgaaagagtaaaaaaagataaaattaatttattttatttaatccaaaaatatgatttttacatctgttcaatatgagaactataggtaggatgttggacatattttttaaattaacgattccagtgtgaagtgtattttatacttgcaacacagcttagtttgaactagctacatttcaaatgcttgatagtaacagtgacctatgactaccatattggacaccgtgggaatcaattccaaaataaaaagtataaattacatgatctttaagtgttctttcagcttttctttcacagttttctgttgagtgatttctatacctctaaactacgtgttccaagaaacaagtagaaagtgaatatatccttgaaatatttagcagtaaataaaaataagtaatttattatttcttatcattgactgttttgggaaggaattcactaagtagaccctttatcatattatcatcaaggaatactacttatttcttggttactactatctctttgatacatttaaatacattattaagcttttattatgacccgtgagtcctatttaatttttaagcaatgcatttgtagaattcctctggttttactagagttaaccttttattttctgctaatgacttaaaactcctcttagaaatgtatttaaatgctcacgtgtacaaaagggaaattgactaataactgattaagttatgcacaatattttatgtgtaagctttatttttataaatcgtgtttatggtcttcctaaataagcagttaaggaaatacatataaatgttagtaaactatcaattatactgatactatacatgaattagacaaagttaaaaaatttagaaaatttttcaacctggcatataacatgtgtccaccttgaatataacaaatccagagacacaagaaaaagccaaatacagagaatatgattctttggttatgagcatgaagcggtgctgcagtgtttggggaaaagggccacaatcatgtctgctggggattcaccctgtaattatatcaccatccagctgaatgcaaacctgcagggaaaatggttaaggtagtcttgtcaaatgttgtgcttgcaatctgtttctctgcatgctgacaagaaggcaataaagtcaaagacaactacacaactaatgtatactggagaagaaaactaggctcagttgcaatgtactgtaacaattttgaagttatatagtaccactaacttgagtgacctagaaaaattgaagttcaagatggtagcattatataaaccagtgaatcgtgtcattaccgtatggatacaaaagtggattatttattttaaatattctattcagttatctgcgtatatctatcctgcatatatccatatttcacagactgcaagaatacatataataaaagaaggcaaaaaaaagcttttgaaaaaagaaaatatactgggaaatgtaattttaattctgtaaattgtaaaatactaatcttggtgatttgggggaaggagagctgatggaaatgaccaacaaaagttgaccctttgctaaataatgaaattgtatcctctgcctagcttacttgatctcttttagtcagcacagctgtgtgctattaatattttctcttataaggaccctgagcctgaaaaaaattaagttgcacagtacacaatcattaaactaaaaagctagatctatctaactgcaaagctcacattgtttacaagttacttgaaagtctagaaaattcagttctgagtcttgccagttatgtccccaaacaggaatttgacccattggactcccttgtgaatcactagattaaccaatgtgcttattagagcccttcagaagggccaagacatttcttcctgtgaaataaatatggaaacaagatattaaatatcttctgtgtttcagaggaaaagtcatgctcagatattaaatacatacaaaaatgtagcaatgaaataattggttgcaggtgctgttggtgactcacccatatctcatcaacacacatcactcttgtgcattccaactggaagcacctgagactctttctgaaggcttttctggccaaggtgtctggctcaactgaagggcaaatggaaatgcatgcattcatatcacctgggagcagccctgaatcaatgactggcagctttgtggatcaatatcctagttcctttgttccttggtggggagaaacctgagacacagtatacattgcttctcaaagttgagcagtggtgttgggttccaaagatcttcatgtgctacggtggtagtctgctcaacatctcaacatcgtactgattccttgtccccttgggatcataccagtgcttcccttggaacatctctccccacataatattaatactcacgtatttgctcaagttcttctgggagaatttaatgtaatctgtaattccagtgctggaagttagaattttagtatgacaatggtaatcctttaaactttcacaaaacaccactgctccatttgtttttttcctattgcagtaaaatatagaaagagaatctagaaggaagagcacaaagtctataaaaataagaggggatgagagagaaacaggaaagagaaatgaaacgggagttgagaaaaggagggaatcacaactcgggagcagaaatgagtaaaatgtgagcaaagcaaaggatcacggtgaggggaacattttccagaggattcttttgaaacgacttgctggaaatttggaaaatgagcaacagtaatgtcaaatactatagctctttgaaagagagagatgaatgaataaataaaaaatatttatttgttcaggcggaagaatctggacaaataagtgaaatttgcagtgaggatgatgattgttcaatatgaggatggcctttctaaccgaaaccatcttctagggtaaagctacctcttcgtcacttaaccccagcttcaatgaagttgttcagatggttggtgtttctgagatttggtttattactcattatccaataaacctgtgaatttatagtcaaaaaaaagctgatggtgggcagacattgcttaatgatcagctagtatctgcatacctgcttaataccctgtaacatgattttgtctgaaaacacctagtttcccagactagcgtctcttctaatgtcaactttcccactgcactgccaacgcaggcccattcattcaaaatttaagagacatttgtagcattccttttctgtatcgggtttgctcaatctcactgagaggagtcgagatctctacacaattatctcttataatgaaacatgcattgatgagattagatacagtttattccatagaaaaaaaacctaaagttgctgtaaaatgtgtttagttattgtgaatcctttctagttggttataattacgtgattggatgtaatagaaaaagtgtgtattccaggaaacctggtttttttgtttgtttgtttgttttgagacggagtctcgctctgtcgcccaggctggagtgcagtggcgcgatctccgctcgctgcaagttctgcctcccgggttcacgccattctcctgcctcagcctcccgagtagctgggatggaaacctgtatttttgtcttatcttgaactatacctaacaggttaaccttggaaagtcatctagctctggaggaccaaagtttctttgtctataacatgagcttgaacaaaatctccaaattccactacctttggttcatgaatagactacaaagatgtgattcaaatgtgttggaactgaatgcaaaaatttgtgagcctgtgcatttttctgcgagagggaacatagttttaatcaaattctcagactgttatttgaaacattttaagaaatgctgaattgtactaccttgaagatcttactttttctgaaatactttgattcataattctatgactcattacctctttggcaatttcgaatagccatttctaggaaataaacttcttccttaaataaatatcaaagttacactgatcttaaaataatggtttatctagccatgaagtatttcacatctaaaagaaccgtttacgtttttggccaattaaaattgatacatcaaatgttagaaaaaactgaaactgtgggctgaattacacaataaaatttcaagaaatgtagaattttgaaacagtaatagtgactaaagtgaaacaaaatatttttttaaaatatctcataaaagtcaagtctgaaacgtaaaatttctcaggtcctgcataatgtaaaacggcttaataaaagcagcaaatataaaatgactatgataaaatactcaaaaaatggatgttgtcttttgtgagtgtactgcctcaattcatatgtatatgcctgatttaaaataatatatatttggattttattggtgtgatggttttatttggtttgcttttcttgtataatccttagggttaattttttaaaaaaagtaaagaaaaataaagaaaattggagtaataaaaaccctttaggaagtagtttgttagatattcatcattccttgaatcttcaaattcactgctcagcgtggggtagacatcctgcctcactgaacgttcaattactttatgggctacagctcagaaggcgaatcacctttttcataagctgcttgttgagagaagcttgaaaaggatgatattgtgtggaggttcaatacctttgaatctcatagtaaaattacaaaattattgttgatttacataagcatgttatttatctcaaactactcaccagttaagttgagactcattaattgtacattttagggtattatttcatgagattaatgaaattagcgattacaatacgttttatttttaggatgctttcaaattatttacaacctatctgtattacactacaatcatgtctaagagaggaatattgccataattttggggaagactgttcctatgatgatgaatgagtgtatttttcaaaatccaaaggacaattgactgatttctaaaattcaatcctagggtaacaaagaaactctgcacttataagcattgcatatttgttttaaattataagagcagaatgttagttcatttaatgagtatatatatttgactttaatcttgttttgttgaaaataatgcataaacgttaatggaaaataactgaaaccaaagaagggaaaggtagttgtgtcaaacaccatataaaaagataaatatggctgggcatggtggctcacgcctgtaatcccagcactttgggaggccgagacaggcggataacctgaggtcaggagttcaagaccagcctggccaacatggtgaaaccctgtccctactaaagatacaaaaattagccgggcgtggtggtgggggcctataatcccagctactcgggaggctgaggtaggagaatcgcttgaacccaggagggaggcagaggttgcagtgagccaagattgtgacattgcactccagcctggaggacaagagtgagacttcatctcaaaaaaaaaaaaaagtgaaatttctaaaataataaaaaagtcactttaaaaaatcttaaaatatgaaaatgacatgaaatttatagaagtgttgttcatttttatatgtaagcagagaatagtgtgtaatatttaaattctttccctaattttttaatattctttacaacatttgttaaatataaggtatattaaacccaaatggtgaattaaactcaaactcaagacactacatgaagaaaaatattccatcttcattatcactatccattttctgtaacattcagagtagttgaaaacttactttactaaagagaggtgggagagggttaaaatttgttattaatattaactgcctatatgagttttgtgttcctttaactttgttgaatttaattattcaagtaaaagtagtctattcaatcattaattgtatgcaattctattatgttataaactagagtatttgaattcctaattcttccctctgaaaatagtaatataagaattttatatgacataatttgataaggatctgtgactataataaattataaatccaggtgtctattcagttttagacttctgacctcaagcgtgtgaaacaagtgggtatgtaaggagagatcacatcattcacggcatttgcattttatatgtcctcaaaagttttcttctaaaactgactgttttgctaattttgtagtaattttattctagatttgttcagttttgataggttttctccattcactgccaacatccatttgagtattcgaatactatgtagatgtatttttagtaaaatatgtttcatttttataattggatccacacagtgctggagaattctacgtgttaaagatgtataaaaataaaacttatttaaaaattaaatgtaaacttacgttctcacaacagagtaactagtatttcaaaaatgttcatatagccttgcaaatagttgaaaatatatatttagaatttagacatttttattcatcttaacagttctgttcactgggatgcttttccacaatactcttaagtcattgttgtaactgaaaatgatcaagagtaatcatttagcgaagactttgagttgtctccataaaagaacttaagcagggagaatgatactccctgcatttttcctgcagatgacattgcatataaatgacacctgccgaatcatgccaagacatacaatctcatcgtgaccatggaagctcatggctaacggtgctgcctgctagttgatccaaaaagttgggttcctgccagagatgtagagcaatgcagtacattgataattactagctagctctttcacctctcttcccataaatgttaatgatagccttgaaatcccaaagcatttctttaacatttctattctttttgtgcaaaattgtgactgagggaggttaatcagtattgccaaggagactaatggtggaagtttctgctatgactcttatctccagttcataaaatacagagaatgttttttagatatataacacctttagccttttttaagtccttaaagttggatcccttatatcccacatgtattatgcaacatttagctgtgaatatgcaggagatattagacttgacataacagaaaacaatgtttgatgatccagtgagagtacatatgagagaattttgaaaatggtaggactgttcattattattaatgttgttgctatgtgtgctcaccccctccaagtcctttctgcttttttactttctttcttgtaattaaattgaataattttaaaaatattttgaaaccaagtaattctaaatatcatgtggcaagagaagaggaaataaagtgaccttttaacaattgggaattataaaatttgtaatatttatcttctccattaattatatcatcttatggttttctttcttatagagctttcctcatttagctacattgaaccgggacatatccatatatcgatctcaactttagccgaattttcttagcaaatgccgagctagagcgaaatttaagaaggcatagtgataaggaaccgtatccctacccccattttgttatatgctaacataaggtcttgctgcctcatttttaaataaacatttttattttagaatacatttagatttacagaaaagttggggagagaatatagagttcacattcccgttatcaccgacaaccagtttcccctattaactttttaccttaatgtgctaacatttgtcataattagtgagccaatatgcatatattaagcctaatgttcattgagattttcttaggttttacctttagtccttggctttcttttttggttccagaatccaatctagctcaccatattacatttggtcattatgcctccttaggattctcttggctatgactgtttctcagactttacttacttataatgactttgacagttttgaggagtactagtcaggtattttgcagaatgttcatcaactgggattgacctaatgtttttctcatgattagactggcattataggttttagagaagaagatcacagatgtgtcattctcaccacattctatctaggatacacactagcaacacgacttgtcactgttgatgttgatcttgattacctggctaaagtaggatttgttagttttctctactgcagtgcagactctttccatactgtagtattgggaaggaagtccctatgtgcagttcacatgtaaggctattatgtctgcctctttgagggcacagtgttgacataaattattctacatgggccatgtataaaattttattattcctccccatttattcaatcatttacattattatggacacatgaaatttgattttatcataatttggattatattctaatagtaccttgtttctctttttaatcaaataatttcagctctggccactggaaactctttcagttgccctgtgtcctttgacacacctgcatcactacagagtttttgaaaagcatttctttattttctggcattacaacttgcatcactgttatgtatgtgtatatatatatatacacacacgtatatatatatacacacacgtatatatatacacatatatacatatatatacacacatatacacgtgtgtgtgtatatatatatgtgtgtgtatatctatctatctatctatctatctatctatctatctatatatatatatgttttagcttgtatattttttgctccagtcttagaatcaaccttctaaggaatcctggtttttgttgttgttgggtaatggtacttaccagaaaccagtatctggatgctatgtatgctcattgatagtggaatataattgtgcaaggggatatatgtgtttctactaagccatgtatatatgcatatctataaatttctatatctgtgtcttcatatctgtttgtatgtatattcatctgtatgtatatttaacttaatgtgtgttcatattgatgtatccaactataatcaactataatcaattaccatgtcaatcattctaaccttctccccttgctatttgtaacttcccaccccaatagtaataaacgtggatcccaggctgggcgcagtggctcatgcctgtaatcctagcactttgggaggccgaggcaggcggatcacctgaggtcaggagttcgagaccagcctgaccaatatggtgaaaccctgtctctactaaaattacaaaaattagccgggcatggtggcctgtacctgtagtcccagctactcaggaggctgagacaggagaattgcttgaactcggccagcggaggttgcagtgagctgagatcatgccattgcactctagcctggacaacagagcgagactccatctcaaaaaaaaaaaagaaaaaagaaaaaagaaaaaaaaaaacctgtatcctaccattgccatcaatttaattacttgttaaattcttgttatcatgtatgggagtttcagaattgttagtggtagccccctggagaataactttgtcaaacagagaacaggatttatgtgcaatgactctagtcttgcaaactctatttccaaagttgcctaggttagcatcacccctctcccctgccaccacataagtgaggttttgttacattttcatatggttagattatttttttcacattctgccttctgacatgtgatcctgacttcctgcatacgttttaaagcgtttttcatatattaaggttttctcttctgtatagttctatgggttttgacaattgcataatatatattcaccattatggtatcatatagaatagttccaatgccctaaaaaaatgccctgtgctttgcccactcaactctctctacagaaaaccctgcaactaataggtgtaccctctctgtagttttgtctgttccagaatgtcatataaatataatgataaaatacttaactttcacagataggcttctttcacttagtaatatgtatttaacattcattcttgtctttgcatggcttttagcttatatttttaagttcattatatagttgtatcacagtttatccattcacctactgacattttggttgtttccagtttttgcaaattacaaatgaagctgttattaatgttcatgggctgtgtgtgtgtacataagttttcaattcagttgagtaaatacctagcattttaattgtgggtcttatagtgagaccatatttaactttttaagaaactgctaaattgtcttgcaaggtggttgtgggaatgcaaaacggcacagctactttataagacaaattgaatgtaagttcttgttactttgtgttctcactgagaataatattcttagttttgtggatgttcgccattctagtagttccgtagtgccaccacatagttgttttaatgtgctctaacttaatggcaaatatgttgtgtattgttaatatatgtttacttgtcatctctatatcatttttgataccgtgtctttttgattatttaataaatagcccaatttagtaattgggctattttcttaaggctgggtttcaagagttctttatttaatttggatatatgtaccttatagaatatgtcttgcaaatattttctcccaggccatgctttgtctgttaattcttttaagtgtcttttgaagagcaaatattttaaactttaataacgtccaagatcaattttttatggataaaggcttgtgtgtacctaaaaacttttctctaaatccaagagaaaatccattttattctaagtatagttttttaaattttacatttagaactatgatccattttgagttaattcttgcacaagacatatagttggtgtctgttatttttattttaatatgtgaatgctcagcattattactttttttatcaacatttcaacaaagcagaaagattatcctctcttcatttcaaatgcctttgttaaatattaattttgtttgtgtgggtttattttactggttttctactctcttccattttctattcctctgccaatccctcatagttttgatgactgtagctttatttgtcttggaatacagtagcatgagtccttcagtttgttcttttttcagtattgtagctatttcatgtctctttccttgccatataagttttagacatggtttgttaatatcagtaagatagcttgctgagagtttgattgggattgtgttgaatctataggtcagtgtagaaagaattgacatttagaagtattgagtcttccaagtcataaacctggaagatatttccaacaccctcttctttttaccctgagaaataacaaaatagtgatatttttaacatgttttcctcattaaatatgtcttataaattatgtaggtccagaagacaaaaaagaaaaataatctccatccaacaaacagcatagattaagattaaatagatatacaagtatctgggtcttgccaattaggttttcaagtgcattcatacaagaaatttactggaacacattttgatatatattaattataaggctgctttaatattatagatggcatagaaattaaaattcattgtgcagaagattgacacatatggtcagagaggaaaggagactcagggagcagcacattattaattagaagatgggggaggataaacataagactctctggagaaaaaattaaggacatgagacaagaaataacctgaatctgttttgaagggatagagatgcataaaaggactggggtattagaaaagactactttgaaaaaaatgagagttttgagttatgagaccagaaatgaatggcttagaaaggcatcctcttctacccacaaattatacttgaaaaataataatcaaaatatcatatgttttaaaaataaaacacaggcttattatttgaatctcaaaatttattttcaaattaacaaactagtatttgtctgtgagttacaaattctatacatttgaccaagttccatttacagagtgaaggcagattttcttcttaataaaagacgcattttaagaattctgaaatgtaattgaaagaaaagactggcaaagacatatgaggacacaaatattccaaacaattatttggttgttaacatgccaacaaaaggttggttttcaaaagaccatgtttttttaatttcagaaaaatacggtttcagtaattctcataagtaattcagcgatgagctatcagctaccggtaatgaattctcctacaaaggaataatttattcccagtgtactcacacaagctgggatgttaccaggaacttgaagctgtaaaagaaccctatcttattagctacaatgcctcactcataatacatacctcatgagttacatattaaatgatcagaggttatttatcttcatacactagtttggaaatggatgaatcatttctcatttcttctgaaagacatacattgtgcttttgctcaaatttcaatttcagagcttcaaacttgtgatacttatctaaatgaaggattagactcacatttgcacacacacaaagcacaaaacaagtgaactaccatatctaaaggcaatagatattacaatgaaacacattaacaataatgtttacttttctaaaaatgttcagttatatattaaagcaaaatggtatttcaccctaattctatgcaaatgtttttgttaaggcattcagttgcttaattaatggtattgaattttaaaaaatctattggtttgcaaatcaggttcttacgcttgtatctatcattctgttctgagagggttgatttatgggtacctataaataaaacagaaatctaaaaaatttagtgagtggagcccagcatgcttcaaaatggaagttgaaacaccaccgtatactatgatcaaatatgttgacttagagttactaattttactttaggcttgataagaaaggattgtgtgtaatctgaatacttactggtagtgagcatatgattgtgtgcctgtaaatacagaatatcattgataatggaaactcaatgtatccaatgcttagttatttacacaaaatacatcaactcatcatgaattaaagactagatcaaagtcataaaaagtaaaaagatacaaaagaaaaatgcatttttcttagataatatcttcattaaaataatagttaaaaattagtggggcttaaatttattgctgtgtattggggcttgtggtgttctttatgtgtacttcaccccatttaacctgaataacaacatgctagttataacctcatagctttaaaatggaggccattctgaaggcctaacttcattgggtcatctctaatataacattgcttcttttgtaattccagcctcatttttctttatttctgtattagcccattttcacatttctgataaagacatacccaagactgggaagaaaaagaggtttaatggatttacagttccagatggctggggaggcctcacaatcatgacagaaggccaggaggagcaagtcacatcttacatggatggcagcaggcaaagggagagcttgtacagggaaactcccatgttttaaaccatcagatcttgtgagactcattcactctcatgagaacagtacaggagagaccagccccataattcagtcacctcccaccatcttccttccacgacatgtgagaattgtgggagttaaaattcaagatgagatttgggtggggacacagccaaaccatatgactttcctaaactgactgcttgatatttgtatgcattatgtatgaaaatacgtattacttcatgtaaaatgaaagctgtttgattatgctaaagaaaacaattttgtactgtatctagaaaagaaaatgtttaattggtcagcattaaaagaatgagtaaaatcccaaatcaaagtttagaatatactaaatgtaataattacctccttatatcattctcttgtaatgtctagttcttcaaaaagctttataggaaatggacgtaggtactattgagagtagaattttaattttaactcagggaacttaaaacttttatgtaatgaccttcacagtatacattttgcaacctgttattttagggcattatcaatttctcagatcaaagtttgaattacagttataatattctgttcaccaacttccttatttaggtacaaaaggtttaaaagatctaaaatataaatgcatgaaaatttagaaaactgtttttctcctcaaggaagcaccaaaatggaaaaaataatgacactggttactactttcttcttttatataactcagttggttttaagtttcagcttcaattcctcagttttgttctatttggtttgggaaagtggtacattatgtatatacaaatttatgtgtgtttgccaatgagtgtgtggtcacgtatatctttgtgatttattatagtataattttacccagtttttccaaagatatatttaatagtactaaatagaaaatctatgatatccatacttgttcatatgggatatctttttccacttcctttaagcaggaagtaatttcttagactgaaatgagctttagaccattcctatcacctcagcatgcagacaatattggtccctcaagggaagataagttgctgataaatctgtagtataacattagagaactcaagagccacagtatcagattgtcccaacaaaattttagagcaccttgtttatcatatgcggaatctatgaaagctaatctaagagtagatagtagaatagtggttaccaggagctagagtagttgatcaaatgatataatattttaattaaatagagatgtttaagagatctattatacaccatggtgactatagttaacaatacattattgacaaatgctgagagtggatgtaaagtattgtcaatacaaaaataattatgtcaggtaatgcatatgttaaatagctgaatttagtcattcagaatgtttatatacttcaaaatataatgtggcatatagtaaatacatacaattttatgtcaattttaaaaaataaaaaaatgaaaaaagaaaactatgaacccttgagcactttagagagagtagaactttcctgttacattcataggatagtatttagagactgtacttcgatcaagtatatgagcacagaaggacctagtattaagagccccggagcaaaatagtcatctcacagaaactagatcaaagtgttaagaatcatttaagcagctacaaatacttcctgaaccatattttgcccacattacttgacggttattctttatgaattaatatggaaacttaaataacctactgcacactctatataacttattgtaaagaagtaagcatgtaaagtcatacgggctcaaactttcacgtacctgtgagatagtgttccactttatctaccaaaataatctttatttatgataatggttgatttcccttatcttttaggtcacaatacatgcttttgactaatgttatctgcttccatactcaacataattcagaaatgttcttcctaaaaaataacatgctgaatgtcatatgctccaaattgtgtgtaactttaaacaagttggcagagggctgcctcctacaagtctgtcccctggcagttacccctctcactcctcatcagccacacacatagaattacatactatttagaaacgggctaatgtaggcatgagaaatgtaatgtctttgtcataatatttgtcactacttttaataataacccttctaaaacttgtgcaggaagttaatacttttctttaaataaggtttattaaaatccattaaaaatgctataactttatcaaaaatatatcattttttaaaaatgtagaacagagcagttgaatagtttctctaggtgtcaaatttcaacaatatttgttattgccactatataaaatcttctaaataacagaatattttataccaaggaattatggcatatgatttcctgaaaatgaaattttccttgatgatttaacatttccaacaaccctgataatcatcatcaaatatatatttgttaggttattactagttactagaactataaactaggccgtatatttaaaaaacaattttcttcttgcagattatatgttacatggaaaatcccaaaactttatggcacactgtgcatgagtaataacaacaagaagaaactggaggcttatgttttgagactggttcacacagaaactgcaaataatagttaacatagggaatacggtgatgatgagttcattagggagaaataaatattgtattgcattagccttcatattttaggatggggtatacactggatagttaagaaattttattttataaaataaatttgaccatataatgcatagaatatggtgttcttttttttttaagttctggggtacatgtgcagaatgtgcagctttgttacctaggtggtttgctgcacctatcaacccgtcatctaggttttaagccctgtgtgcattaggtatttgtcctaatgctctccctcccctagcccctcattcctagacaggccccagcatatgatgttcccctacctgtgtccatgtgttctcattgttcaactcccactaatgagtgagaacatgtggtgtttggttttctgttcctgtgttagttttctgagaatgatggcttccagcttcatccatgtccctgcaaaggacatgaactcatccttttttacggctgcatagtattccatggtgcatatgtgccaccttttctttatccagtctatcattgatgggaatttgggttggttccaagtctttgctattgcaaatagcgctgtgataaacatgtgtgtgcatgtgtctttatagtagaatgatttataatcctttgggtatatacccagttatgatgctggaacaaatggtatttctggttttagattttgaggaatcaccacactgtcttccacaatggttgaactgatttacacccccactaacatggtaaaagcgttcctgtttctccacagcctcaacaacatctgttttttcctgactttttaataattgccattctgactggcatgagatcgtatctcactgtggtattaattttcatttctctaatgaccagtgatgatgagcaaaaatcacaagcattcccatgtaccaacaatagacaagcagagagccaaatcatgagtgatcacaattgctacaaagagaataaaatacctaggaatacaacttaaaagggatgtgaaagacctcttcaaggagtattacaaaccactgctcaaggaaataagagagaacacaaacaaatggaaaaaaaatccatgctcatagataggaagaatcaatattgtgaaaatggccatactgcccaaagtaatttacaggttcaatgttattcccatcaagctaccattgacttttttcacagaattagaaaaaaaactactttaaatttcatatggacaaaaaaagagcccatgtacccaagacaatcctaagcaaaaagaacaaagctggaggcatcatgctacctgacttcaaactacactacaaggctacagcaaccaatacagcatggtactggtaccaaaacagaaatatagaccaatggaacaggactgtgttcttaaaatatgaatttttcgactgcatttgaaaggaaaacaaatatttgaaatggtcaattgaaatcgaccacattgaaataatttaaagagggtgaaattaatatattcaaaaataaattctgccagaatcatagatgtttgggacccatttcatgtctgggcacctgttattatgggcatgcctcctacactgaactaaaatttacatccctgaaactccaaggctttcggttctgtcccaaggtaaatctacatcctcttccatgtgagagccttctgagtatttgatgaataccagtaagacaaatgaccccaggttcttcacttgttctttacaagagaagttttctggtctcttctgaattctggttagtcttctctaggttgcaaagatctttcgtaaagcaagagttctgaaaagatcaaattttatgtgtgataaaatggcacgctattggaccatactgagtctgctgtttaattttcaaccaattcttaaattatttccacagtgaactacatactggctggtatttttttaagaatctctcacttacatacaaactcactttaccaatctccaagttttaatgtcagtcaatactctcttttgttgttgttctcccaaatacaaatgttcaaaatcttactaatgtaactttcttcagtgcctgctcaaaggctcagaaatcactttttaaaatttactttttaagataaaaattgattaaaagtatatcatttactccaaccattcatatgatgtaattactatgtgttagagactttattagcaagagcatattctgcaaacaaggtagtctgggctttggtctcacaggagtgatgatggacatgtcactatgcgtctgtatgctttagtttcatcaaatgaaaatttagagagtttggttgtgtgaggaggaatgggtttgactgaatcaggaaaccttagtggattcttagtgattgtatttttcattggtaaattcccatgacctattcccaaagctattccagggattttaggatttgatataaaaaactacaattttcatttcatgtgaatatatttttgttattttacagtaagaaaatgttcatgttaaaactatatgagcaacataggacagcaaatgaatttttagtactaaatataaaatgcctcaaatatactggcatccaataataagattttaaaatatcagattttaaaatcgatttagacttaagtaacattggccatgtgttcaaaagatgggattttaatatacagactattgagatctaatacactatgaatatccaatgaatattttcaagttaattattcaaaaatcaacattttctgaacaaaaaaatgaaaaagataagttcttaaccataacgtagagtaacatttacaatccaaaaccttttgatctgaaatatcaaagattataaaaaatattagcctatatttgtagaggacataaactttttaaatataatttaagaatataaatttataaacaatcatgtagtcataaggaatttaaaattataatctatgaatactcatcaaaaatcacattagaatttataaagatcctgaatttatagtaaaagatttattgcttccatgaattagcaatttggctgagctaatttgtaaatgatgtggtcgcttgaaagactatacacaaaagaaaattggtaagcaaaaaaaaaaatacaaaatatcggaagaattactgaattgagagaatgaatgctctccacaatcaatgtcattaaaaaagcaactttctgaaataaaagagaactgtctacttttttctttgtcccttttttagtaagcagtttgcctctggtttaacaatatgaacatacttcctttcccagctggaggcatccgatcctgggaatattgatgtatgtacaccccgtagattatacttttcagactagatggatttctaaattcaagatctaccaaatacttccacaattctaattaaaataagaagtttgggagtcagaaaccttttgccctagaggcttgccccaccatgtattaattttcaccattattccatttaactggggttactcatttttatttcctaaaaaattctatatctggaaagaggtaccattctacagcatttctggcaaatcataaattaacctacagtaaatgacattaaggagatagctttgttctgtaaatggataggataccatatggctttgatgttagtgtgaagttaatcacaagctccataacaggccatgacatcatttcataataaattgcatgaacaaatgctgccgttatctgaacagcatgtgaattttggtacctataatctttagggaaaaatgaatataaaatattgagttaaaaaatagatataaggatggtaccatagcgtctccactaaaaatacaaaaaactagccgggcatgatggtgggcgcctgtagtcccagctacctcgggaggctgaggcaggagaatggcgtgaacccgggagacggagtctgcagtgagcttagatcgtgccactgcactccagcctgggcaacagagcgagactgcatctagagaaaaaaaaaaaaaaaaaaaaaaaacagaaacgtctaagttgcaggaagtcagtaggtgtacttttggagtcatcttaaaaagagacgatagacatttcttccatttctccctttgctgccatctggcaggcagcctacaatgtgattgatccagtaggaagagtaccctatgggccaatctatgagccctgctagctaccctggaaagaggctgaggtgccttttttcaagaccccaacactagctccacaccacccaaccacatcgtttaaatttcagttattttctggtacacactggtacacatttgccaattatgtacaaagactgtcaatgaaatcagctgttcactatgagattacagtgtggctattcttttgtaacaaagtacttgattatctagagtattttacttcaaaatatttctgaaaaccatacttccctgtgccgaatcctcagtcagaagagagctgacaatcaatacagaagtaacatattgttggaaagaataattagaacattaatgaaaactgatctcattcatttttcttaaaaatggaggaaataatgttttctgatttctctccatcattccaagtgcaaggtaccacgtaatttatatgtaattcaaacatcaatagagagattttttttatattgattgctcccactttagtagtgctctataaacaaataaagaaattaactgattttacccctgatcagatgatctttctttggagatgtgacatttaatctgattattcatgaatatgttaatgagagagttatcacatgccagtcattagacactgaatattaaaatgcaaccagtcatgcagtgttgatgacaagcttccttttccaatttgcaaggaaagaataagcaaacaagatgagtctaatctctgggttttgttactttttgtaaaatcttcagtggcacttatatgtgtcaagaaaaaaataatttcttaaaatcgcaaactcagggactgcaatgttttttgtcactcattccaattaaaccaatggcacttaaatttaacaggaatgagactttaataattaatagagtacagttgtgtgtttctaatatgcaagcaattccaagttgataaacagctttggattaccaaagtttactggtaaagctactgttaggaacttaaactagtcatgtattttctgtaagaaattactttgcaaagaatggtaggaaatcagagatttaatctcactccaccaagaccctctgagggcaaagaaaatgtgcgtccaggaataagcacaaggcctcaaacatagcacacacaaaataaagattagatgaaggaagaaaggaatgaaaaatacctggatgtgctatactagtagtgtataaaaatctaatcattatttaaactttgtttctatgtgaaaacttaatggaagattccatattggctctaagaaacacagcagctctcttcctacctgtctgccttagtaaccagcagtgagtgacacttttctcttacaaccagccagtggcctcaggatgctatgctagtaacaggagagcatgaaactcctgaagtgtcaggggctgtcatggctttgtgtggacattcttaggtgaggtacagcgatgacacatcgtagagaagaggaggtggggtagtcaatcgcctcagacactaaaccataaaacatctctgaaagtgtaaagcaaagaagaaaattgtattcatcagaattcttcttaaaagagaatactgggtgtattacaaggacctcttggttaagctgcatggggtagactgtaagaggcttttgtctgttccactcacagcaaagcccgtatgctccaggaattgttagtaattgctgtgtttgtttggtgaagtggatgatataagaagcagggagtgctgccttccggagtcctccttttctgcctttgttctcatccaggtgccaggactcatctctaaaaaaaaaaacagttgagaaaatatttagagtatcagtttgaaggggtttcaaattactctgctaagagcaccgaaatgcctgtctctagccaggagtcaataaatggggcaggaaaaaggagggactgttccagtggcaagtgaatggagccgcctaaagtattgcttgctcactttagcaaactgccttatagtattaaacagtacattatgagactgttttcaccaaacatcttgaacaacagacaggtgcatttttcctgttattaaaatgtgggtcataaaggcaaagctacagagacggaaaacagatcagtgaattccaggacacaaaagtaggggagaggtggactacagcggtgcccacaggaattctgggcagggcaggggggcggggggtgatgggattgtgctttatcttgaatgtgctggtgattaccaaacatatgcatttgtcaaaacttatggaactgtatgctaatcacagtgaattttatggcatgtaagttatattttaacttacgaatttttaaaaggcattatattattactctgaagattcagataaacatacacacacatatgaaattcaggaggtgttactagaaaaaaagcccagtttctccttatctaaaaaaattgccgaaatgggctatgattttttcaatatcttttccaatttttgcctcttataattctgtgtttaaataactaaagaaatctgaaattacttagcaactttgtactagcaatggtcattattttacaacctatgctcagatactaattaccttctcataattgtccagtatgcaactgagaaggtcaaccactaaaatcattttaatttcccttcagcttcactgattatttgtagagagcatttcgtttctaggtcaaatcgtcttaatacacacagatcactctggttgagccaaaccagattttcttcaaaagctctgacattgagaccctgctctggcatttcatttgtttgtatagaaaatgttaggcgtctctttgccaagtctaagctgtgattccaaaatcccctcataaccttgcttttcaactgtattccaaacatatataaaactgaaattgaccctacagtcattgccagaggcatacatagagagaaatgtacaatcacagtgtcattggacacacgcatataaattgcgtatctctaaacttcgcaaatctaatatggtattcacaatttgggcaataatgtcagcaacaaatttaattaaataaaaaccttgagagaaatagtggtttatttctgaaaaccaaatattgaaattttgctgagtggcttactttaaatgatcagaggaatgcttcataaattcttgcagtagcatcgtaagactttatgaccatagattctctgatacatttattgggacaccttgtaaaatagtgaagttgcagaaacacaaaggcatagtttttaatttcacatttttcaatacatattacacatgaaaactaaagttttaattaaacaaaggaagtcttaagtttgcattttatacattgattgacaagatatctcttaacataacatgcatagccaagttccttgtgtcacttgctttgcttttttcattcttccttaatttttactaggattttattttctatttctttttcaacaggaagctctgaagccaccacctagttcacttcaatagttatgtgcttttctacgtttcaccacaattttctcagtagttcagacgtatcactcttgctcgatattgattgagttatataatcactattagcaaatgctctttgatttgatcctttctaatgtgtattttctcagggacaggaccagttttgaagttgaacacacactggtgtgtaatgtgcatgtacagagtgcctctgaactatgcagagtaggaattgattcctaaaccccacataaatgtaactcagactggtttagaaaggctattggatttgaaatggcaaaatactaagatatgggaaaaaataagataccagtttaattttaaaatcagtattaatcatgtttaccttattcttgattttttaaaggaacaaaaaccaacatatatgttatttgatttgtacaaatttgtattattctatataacatccatatatattgtccataaccatgtgatcacatagtgtgtctataaggaccttgtatctagtcatatgtgcacctgttgcagtaacccatgctgtgtaggcaggttctatgacaattcaaatcagttctagtgataaatcaaacctgttggttgcttttattgaatgttgttctatttctgtctgtaagcgtatagccaggttaagagaaactgactgaactaaaggggcgcttatgactattccctaatgatatcacatccaaaacaatgaactgacagtgacttaaattattaagcattaggagaaatccctgtatccctgcagtgttcagttccttgaggctctgacaaatgacctccagtttgttggacaaagtaggcgggatatgaaggcagctcttatacacatactttattttggctggggcaagtatcactggatatctcatttggtagcatattaaaatatgcagatcttcatggatcagacaatattattaaaacagtttaatacagtcaggtgtttcttttttttttttttttttttttctttgagatggagtctcactctgttgcccaggctggagtacagtggttcgatttcggctcactgcaagttcctcctcccgggttcacgccattctcctgcctcagcctcccgagtagctgggactacaggcacccgccaccacacctggctaatttttttgtatttttagtagagacggggtttcaccgtgttagccaggatggtcttgatctcctgacctcgtgatccacccgcctcggcctcccaaagtgttgggattacaggcttgagccaccgcgcccggccaggtgtttcttaacgatgggaatgttgtgagaaatgtgattctaggtgattttgtcattgtacaaaaatcacagagtgtaattccaaaacctagatggcggatcctactatacacctaaggctgtatggtataacctatggttccaaggctacaaacctatataacatacagctgtactaatgctgtaggcaattgtaacactatggtaagtatttgtgtgtcaaaacttatctaaaatagaaaaggtacagtaaaaatatggtaggattatcttatgaaaccaccattgcatatgtgaagcatagttgactgaaacatcattaggcagcgtaggctgtatgcctcaggtgccaattatgtgattccatctgatagcaactatatgaatattatatatttgagactaaaaggctaacataccaatttattttgtatgcagcttttaaaattcatgctatttttacttgtaaaagttctgttcactactttaaaagctgaagcacattaccggaaaaagcatgatgtgacatcgttctctactataaagaaaacacctgataaccaataactttcaaggaacacacaccccatgccacatcctatgcattctaaccattttacaagcattatctcatctcatggaatccccacaagtatcatgtaagatagattctctgattattcccattttatgggggaggaaaccgtacttcagaaggttaaataaaacttgcttgagtgtaaaatatattttcttacctctcactaccatttactatgatacatttactaaggatttattaccctctgaacaggagccttgtgatctcacatttcccaacccctcctccagggagtggagttgatctgagtattcagaagtaaaaatgacagtagttagcaattgctgagaattgtccatgtgccaggcactgtggtcaacacttacaggtattatctcatataataatcagaatctatcaaagacataggtcaattattatcacagttttagtagacaaggacactgaaacttataaaggttaaaagtctttgtccacatcacagctaagaagtggcagagtccgaagaagagggaaggcagtctgactgcatggcctgttctagtaactattatgaaatagccaacggcacccaagacttagtagcttttgaagcttcaccattgaggatgtgcatttttaaagatggggtcagagtataaggaagtcttcctggtcctccttaagttccacggcagggtgcctgcctgtgtactctacctacctgttctaattctggggattatcaggagaagaaacaagaaagctataaaagccttagcttctcatgaaatatcttagcaaaacatttttatgtgaaaaatgtatgccaccttttatgtttatggccttgttttattattttcttcttttggaatatttctttctggagtttacaaaggaattatactgaacgctgatgtgaatcccaaaggaaagatacgtttcttctctaatgttctcaaatgtcaggaaatcatttagagagtgaatgtctttggtggctggttctaatttgcactgttgtttgataatgtgcacactggagatcaattgtctgaagatctccttagggctagaaggtcatctttggtgaattagcctgatgcctcattaaagatatgtcaattctcctttttccttgcaatgtgtagagtatgctctctaagtggagtggcaaaatgtacatgaggagggaaatttagcaaattagtttaatgagaattattgtgtttatttggagacttcgatttgattgaaagaggattttactattgggcttcctttttggcgaaggttatccgtagcacctactgtaattgcttcctgtaaaagagtcagtatccatgcagttgcactaatgtgctcttgtttggtgcatttttctcttctttaatataaagcatcttgactgcgaaaattttaaactccagtgtttgaaggatgaattgatgttgattttctgcaaaggaaaataataaatagacttggagaaaggaaaaggaaacaaatctcactgttagaggtaatgtggaaagaataataaacaaatgtaaggaagacaacatctgcgaacagggtctatctattaatgcttgttagggagaaaatgcctaaaatgtgaataagtaaaagcctaacaagaaataaggtatagcagccttccaatagtttgcaattgaaaagagacaaacttgtccaggcacggtggctcgtgcctataatcccagcactttgggaggctgaggtgggcggatcacaaggtcaggagatcgaggccatcctggctaacactgtgaaaccccgtctttactaaaaatacaaaaaaattagccaggcatggtggcgggggcctgtagtcccagctacttgggaggctgaggcaggagaatggcgtgaacccagaggcggagcttgcagtgagccgagatcgcaccactgcactccagcctgaggaacagagcgagactccgtctcaaaaaaataaataaaaatacataaataaattaaaaagagacgaacttcttccagaagcagaaaatcaaatacttgggcaggtttctaataatttataagagaagaacatattttatgttaattataatgtaggccatattttataagaagtagctggacagttaattctgtttcagttctttttcctctttggatttctttgcttctaatttatttttctgtttctatgattatttctctcagcttcaatctttagctctttctactctttaatctctggttatgtggggtaatggaaggcaggtgctggtgtgacagtggcccagtatcatgacattctgatagattgtattccctttgatctctacttaagagtttcatgcaggtgtttcggaggagagagaaaaaaatgtttttcctgacatttttgtcactgcagagagaattacagttttacaactatcatagagattcagaacagatgaatatatgtctatcagtgagcatattaaaacctaatattttgtgggtttgttgttattatttgcaaacttggcacagtaattgtgaagacaaaaattgttcttcaggctttgtgagtcagattaaaaaaagttttaaaattagcactagtttgtaaatgagaacattcaagaaaagaacatgaaacaaaatatatgaccttaaattatgtataattgaagagaacttttaggttggtgaagctatacttactgttttttaaagaaaaaagcttatcataacttatttaaaagacaaattttgttttgttttgttttggttttttatttttttattttttatttttattttttaattttattattatactttaagttttagggtacatgtgcacaatgtgcaggttagttacatatgtatacatgtgccatgctggtgcactgcacccattaactcatcatttagcattaggtatatctcctaaagctatccctcccccctccccccaccccacaacagtccacagagtgtgatgttccccttcctgtgtccatgtgttctcattcttcaattcccacctatgagtgagaatatgcagtgtttggttttttgttcttgcgatagtttactgagaatgatgatttccaatttcatccatgtccctacaaaggacatgaactcatcatttcttatggctgcatggtattccatggtgtatacgtgccacattttcttcatccagtctatcattgttggacatttgggttggttccaagtctttgctattgtgaatagtgccgcaataaacatacgtgtgcatgtgtctttataacagcatgatttatagtcctttgggtatatacccagtaatgggatggctgggtcaaatggtatttctagttctagatctctgaggaattgccacactgacttccacaatggttgaactagtttgcagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgaagagcattgtttcatgtgttttttggctgcataaatgtcttcttttgagaagtgtctgttcatgtcctttgcccactttttgatggggttttttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtcttgaatccatcttgaattaatttttgtataaggtgtaaggaagggatccagtttcagctttctacatatggctagccagttttcccagcaccatttattaaatagggaatcctttccccattgtttgtttttctcaggtttgtcaaagatcagatagttgtagatatgcagcgttatttctgagggctgtgttctgttccattgatctatatctctgttttggtaccagtaccatgctgttttggttactgtagccttgtagtatagtttgaagtcaggtagcgtgatgcctccagctttgttcttttggcttagggttgacttggcgatgcaggctctttttttggttccatatgaactttaaaatagttttttccaattctgtgaagaaagtcattggtagcttgatggggatggcattgaatctataaattaccttgggcagtatggccattttcatgatattgattcttcctacccatgagtatggaatgttcttccatttgtttgtatcctcttttatttccttgagcagtggtttgtagttctccttgaagaggtccttcacgtctcttgtaagttggattcctaggtattttattctctttgaagcaattgtgaatgggagttcactcatgatttagctctctgttggtctgttattggtgtataagaaagcttgtgatttttgtagattgattttgtatcctgagactttgctgaagttgcttatcagtttaaggagattttgggctgaaacaatggggttttctagatatacaatcatgtcgtctgcaaacagggacaattcgacttcctcttttcctaattgaataccctttatttccttctcctgcctaattgccctggccagaacactatgttgaataggagtggtgagagagggcatccctgtcttgtgcccgttttcaaagggaatgcttccagtttttgcccattcagtatgatattggctgtgggtttgtcatagacagctcttattattttgagatatgtcccatcaatacctaatttatggagagtttttagcatgaagggttgttgaattttgtcaaaggcctgttctgcatctattgagataatcatgtggtttttgtctttggttctgtttatatgctggattacatttattgatttgcgtatgttgaaccagccttgcatcccagggatgaagccctcttgatcatggtggataaggtttttgatgtgctgctggattcggtttgccagtattttattgaggatttttgcatcaatattcatcaaggatattggtctaaaattcgcaaatagacgcaataaaaaatgataaaggagatatcaccaccgatcccacagaaatacaaactaccatcagagaatactacaaacacctctacacaaataaactagaaaatctagaagaaatggataaattcctcgacacatacaccctcccaagactaaaccaggaagaagttgactctctgaatagaccaagaacaggctctgaaattgtggcaataatcagtagcttaccaaccaaaacgagtccaggaccagatggattcacagccgaattctaccagaggtacaaggaggaactggtaccattccttctgaaactattccagtcagtagaaaaagagggaatcctccctcagtcattttatgaggccagcatcatcctgataccaaagccgggcagagacacaaccaaaaaagagaattttagagcagaaatttttttaaaaagaaattcaaaaaaatcatttattaaaataggcaagtacttctaaaagcagggcttgaaggatgcactgatatgtactttgataatgtaagccccaaagatcaggacaggtgtctgtcttatttgctcttctatctcatttacaattccctgaatgaataatgaatgaatgtgtgtatcacaagaaaaaaatcatggctatggttgccattcgaaagaggcacagagttataacactagtcataggtagtgcagatagaagcaagatcattgcatgggggctggagggaacttaaataactagtagattacatataataacctcgattctcatccctcattctatgtcaggcttagagggtctgcataccccctggccacagtgccagtggagaagggtttctatcccgtcatgttctataatatgtatctacgaaaaatgagatcagggaacatccctgtgggtatgaaacaacaaaaactttttgaggaagtgaggaggtatcttgttggagatgggggtgaggggcacttggcatctaatgactgcataactgtattctttttaacagcttgactgagatatatttattcacataccatataggtgacccattgaaactgtgaaattcaatggcttttagtgtatccacagagttatatgttcttaagtcagatctgtggagtcaggtctcaactaagctacccagtgtgtgtgtgtgtgtatgtgtgtgaatttgtatatgtttatgtgggtgtttgtggttagggtggggaactcaagctgcactgacttccagatctgtctgtcttcaatagtgttggtaatatacttcaaaatgagcaatttcttttttcctgtgagctctctgaactatattttatctaaagatactgtctgaaatttcatattaagctatgggaaaagtcacatatgtcactgttacaggtgacgaattactatgttaaaacttctagtgaaaaggtttccaacattaaattcacattaatgatttatagtcttgtattcacactttacaagtgctttgccatggttaagtaagtctcacccattcttgtaaaagtgaaaacatatctgcttaaaagcctggcaaaatgaagcttagaaaaatcctccttttagaaaatcacataatgtagttcatgaacatgttcgagaagggagcttgaacatgttcattgtctgtttctgtgcttaaataccatagctttgtgaaatatatgtgaatgctcactagtttgtgtgtgtgtgcacgtgcacatgtgtatttatgtgtatataaattagaacaagccattatttttaattatttacattaaaattttcagagggttcaggtataaataaatctgtataagtagtataatatatagtaacagtaatgtataacatataagctgtaaattacataacataaatatacattataggtaaaagtatatatacacacagtagttaaatatgtgtattttaaaattataattgaggaagctaattcatccttaagtacatttccggaagttcctctgttggtggacatattctcaaattttctggcataaataatgtttcagtttctgattaaaaccattcttgttatccacactaaatagacttgcctggccagtatctaattttatggtggagtcttgagtcatcagttctacaaagatatttaacctgttcatgataatcacatgcaagagaagctggtcttctgtgacctgcagccagtgtgccagaaagaaggtgtcaagacaagagtcgcctagtgaaacagtgctggtgaatggggaaaaagagcaaaaattaaatggaatccaagccagtttgacacaggacaaattataaagaaaatcctagaacaccctggagagaaacaatgggcaatgattcttcaaccaaaaaggctctgaggcagggcacaatatcaatggtcacaagaggacagggactcccggccatatgccctatgcccttgtctcatcggaggcttgactgagggcagagtctgtagtgccaatgggtgaagggataacaagaggcaggtaaatcccaggagctgtttctacctccagagaaggaggaatccagcaatgctacagcatctcagtccaaattggctccctcgctgtttgacagcaacctttagggctccattctggactttatctcgagctcctttcctcaccccatttcctttaaagaatggccagaaaatctgagcatgatatccttctgttaagaaggagaagaaaaaaataatcttatattagtccatgatgtacactgaaagaaagaaaagttcagtatctttataagaaccttgtctgagggattatgttaaaaaaacaaataactgaaaacataatataatattcaaacttctcttgtttgtttcttggttgttactaggccattaaaaatcttataaaacattaattgtttaatcttggaacaaaatgtatttaaaaaggtttaaaattctgccttattcctcatgagcagtgataaagagaaatcactgggaagcaacaagtgttggcagactggttcagcatggtggctgcgaaaagaaaaacataaggtcttacttgataaacagtgcagcacaggaaatccaaggctcaaactccgttttgaccttcttgatcccaacagttagaagcaatcattctctcctgtcagctttcatatctctttacctattcttttgattagagatttttaaaagaaatcttttactctactaatctatagtcatcctaagaagggttcccgtgtataaagaacatgttttatatttacatgccacagttacattagcagttccatgaatttatggagacttaagtgcagctttgactcttcagcctcagctcccaacctttccaactcatcacccaatgtaccacaattcttatcccatcagaccctggatctggctatagtcatttcctcacctgacctggagccaggactgcacatgaaaatgaggcttccgtatcacaggttggacaaacctctctcataaaatgcttttgtatttctctacttcatgggtacacagaccacttcagggacttaaatgtaacccttaataccttttataaggtagatgttgtgttttaaataagttattttcaagtgatcctttggaacaaactttatgcctttacatttctattttccaagcatatagggggtgagaaaacatgaatattttccccatgggaaagaagtgaacgttttcaaactttataaggaaatgacttttctctttgtagttataatcaggaaaaaaataataaagcccatagcttggggtcatttttaattagaaaaactttttacctgcaaagcaaaaagtctacaaaccagatttttatgctgtgaaaattttttattatgcaatacttctttaaatgttttttaaaaaactaatattttcttatcttataaatgtatgaagattttgagtctaagagaccaaatagatttatgttaaaacttctctgggcctagatgaaattctcagatattttgtaagcaatgaaaaattaattttaaagtgtttttccccaatgtgtaatgcatatttataacctacagaacaaaaaacacaatcatattttggatctttaagacctgacatagcaaaaagataatttgctttgaggccctttgatgcatttaatttaatttattggaagcaaattaatgtgaaatgataaaattattattaaaatggaaatagaagaataggaatgactcaaatcaacagaggagagaagtggctgattaccatacttcataggataattcccaatttaatcatattaaatctaattgttggcggacagatgatgggaaataccgctcttgctttgtagtagacagaagaagacagaaaaaaattttaaaaagcaattcagaatgtcactaggataaaccaaaaagtaaactgaaaatgaagaccaaagtggatttcttaaggaaacattgcctctttacattgccaaatgaaaatttggtagatgaatattctatggttttagataatcatttgtaacttgaaagggatttatatacaacttaataaatatatattgaatgactgctattttcaagatattgtgctgctgatctgtcttctagctgataaatttagctgaatacctggagcaataatagaaccaagttttattgatcaacagcaatctctattaaaatggtaatgaacagcttctgcagtatatcttgatatattttctttttactgggtgtgatgaatgtgtaaagtagtagaacttatgatacatgtgacatgatgtaagttcatgataaatgctagaggattaatttcatatagctacatattgtcattatttcaaacttcagtgaaatgaaaacatgagtttttcactgctgtttttaaatttttgtgatttttcccctcagtggcaattccaaaataaatggaggaaactggaaattattctgaatattgtgtatgaataaccatcttattaaatagactcatttaaaacattttcaaaaatttacatctttctcaataggaaatgggtcctttaattctgctcatttctctccatttttagtgatgttattttagtctaaatttccataatctttattctgggctattatagtaatattccaacaggctttttctcttcctatttcttgggatattcctatttatttcccaaaccatagtcttaaacatcttaaagagaaatatacagaatctgaaaagacacttctcaaaagaagacgtttatgcggccaataaacatatgaaaaaaaagtcaccatcagtggtcattagagaaatgcaaatcaaaaccacagtggggtaccatctcatgccagttagaatggtgatcatcaaaatgtcaggaaacaaaagatgctggagaggatgtggagaaataggaacacttttacactgctggtgggagtgttatttagttacaccattgttggtgggagtgtaatttgtcttacaccattgtggaagacagtgtggtgattcctcaaggatctagaaccagaaataccatttgacccagcaatcccattactgggtatatacccaaaggattataaatcattctactataaagacacatgtacacatatgtttattgcagcactattcacaatagcaaagacttggaccaacccaaattcctatcaatgatagactggataaagaaaatgtggcatatataccctatggaatactatacagccataaaaaatatgagttcatgtcctttgcagggacacgggtgaagctggaaagcatcattctcagcaaactaatacaagaacagaaaaccaaacaccacatgttctcacttataagtgggagttgaacaatgagaacacatggacacagggagggggacatcacacactggggcctgttgcggggtggggggctaggaggaatagcattaggagaaatacctaatgtagatgacgagttgatgggtgcagcaaaccaccacgcagttgtatacctatgtaacaaacctacaggttctgcacatgtatcctagaacttaaagtataataaagaaatatataaaatctgattatttcaccccctcgatataatggaaagagtacattgtaagtcatacatctgaattaaatggaaaaataaaatgatatagtgctaataatcagatatacagaattgtagctttacaaagtataggagataagttactctgaagattcctttcattagaaaacagccagatggactggtaggcacctgtatcgcaactattcaggaggctgaggtgtgagaattgcttgagcccaggagttcaaagctgcagtgagatatgatcacgctggtggatagtgactgcactccagcctgggcaacatagtgaatttttttttttttaaagaacaactagattctccataaaacagactatcacactctaatacataactgagatcacaggaaatcagggagaattctaaaccctcttaactcattctctgagctcatgacagagtgggtagtaagtgaaaaactgaaaaattgcgtatttttttagagcagcttagtggacagacagtattttagaataccagaaagcacaagaaatgtgtgtgttgttatgcagaattcataaacaactcttttgactcaaggaggaaaaacataggatcataataaacaaacccttaacaggttggaaacaagaatagcctgtaacatatgaagggtcactcaaccttgttagtaattaggacaacctaactaaaatgtataaatgctatttcacataacaagactgaccaagggttgtgatgatacgcaataataggaacttacgtactttgttattgatagtataaactggtatggacatgtggggaaaaaacttgctcttgtcttacaatgttgaacattgaattactaacaactcagaaatttcacattttatgaagttcttcttagtgttgtttatattatgagatagaaactgttatctgtatagtacaccaagataagaataaggcagttcctgagtggaaacaacattatgatattctcttattgctgtcactcccttccttagacactggctacaaaaaccaatgaactaattcatctgggcataaattgcaaggttgagatagtgtgtcaccaatgctatatattattctgaaatttgtatgtgggttttcatgcaaaaccattgtctgtcacagtaaagtatcttttgtcatcactaagtaaaaaccttttcaagtaacagactcagaccacgtgcacacaatggatgggcttatattatgataggctggctatcctaataaaatattttaaaaagcataaatggtgggaagagcaatagaaataaagtatgtgaagaaggatactttaaaggtgaaaaagtataacaattagaaataacgataaattgaacaacaatgcaaaaggaaattcccaaaatgcttccaaaacaaggacagaaaagaaaaaagttaaattcagttattaaaaaattaaccccattttaaagccacttgcatttattagtgttaattacttgtgttaattttaacacaagaaaatggcaaactggtaatgccttcctactgtaatataaagttacttcaaagaggaacattttctgaatgacacaatgaatttatcaaggacatggggcttttgggaaatagacctacgactgttggttctctgattatctcactgtgggctacttctgttttcattatttatttgcgatgtgggcacattaccaaactgctttcagaattgcttaatgtgtaaattcctctgaaactttgaacaagagatttttgacaggtatgattagtaagtaggatttcaagacatttgacttcactgaaaaattttactgtcatgacccctttaacaatctttttacttctggagatgtgtttccaatttgggttattattaatgactgatgtattcttaaaggaagagaaatagaatattatagacttatttcacagtaagacaagtcattaaaaataactttgaacttcaagaagtagtagaaatgggaatttgaattttcagaccaaatagatcatgacagaaatcaaagtgtagaattacaataaagtaaagagactggatcatttcagtctattttgatttgacattataattttgtggttgggaggaaaaagaaggcaactgtatttcatcagctttgaagacttcgttgtcgtgaagaaggctggataacttccttatgttgtcactatcttgcttccatccagagactgtggagtctttctggaaccaatatggttgaaaaagcctttcctttttagtcagcagggcttagtattcacagcctctgttttaaatacaatgtaacttgctttattacaaggcatactgtgacttataaagctagaaattctgttcaggtgattacagatgaaaaaaatgatgaaaattgagaggttgccagctcacgttcttttctttctcactaaagagtctgcttctattttggtccattttaaagtttccttaactcctcgagtcacagagaaagtagtcattcttcagtgttgccagctcctgattccagatgagctaatgattccacagagctatctctttggttcttaactctgcacctttactgatagtcattgtagtttaatttttattatcaatgtttatagggcctttgcggtgtgtcaaattttaggcaccccaaaatataatagcgaacaagacattcatggtcactgccttcatggagcttctcggctagactgtgtataaattttcaatctacagagaatgtctctatgtttaataacaatagaacatttgtattgactcttaccaatacatgtaaactactctttgaaaagtacactaaatcccaaagtgtcttttggaaaaggaatgttacatttttaaaattagacctgatagtccatagttgaatgctaatatgatggtcaatgactaggaaaaatgttccaattcaaaacaatttcaaagttttcttcagtacccttgtatcatcatgacttgggaaaatcatcttaggaagtattggatgttatcttggaagttaatttatagaaacatgggtggggcattgtagatcatttagtccttaaatacatttttggctgaaaggaaatctctcattaaaagggaaagaaacagaagaagagaaggaagaagcaaggtaaggtatttgctaggatcacataactggttagtggcagaagtagaaatcatttccttggactctttagtgctttattactgccctcttgtaagtttgttgcttttccactgactgttgggtaagaaattataatcccagaacagttctttgtatattaaaaaaaaatcctttacatattccatagaaactgggcttggtttgtaaagctgaggcccaggagaagctctttttcttacccatttggtctttaatgttgcttgcgaatgcatgggggtagaactctaataacaatgatggacacgatgtccttgcacataaacatttggctcctcacagcatgagatgtctggtcagccacagaggataaaataatggcgtaaagatttactgtcagggagctgggccagtctcagcaggacagcggctccaagcagatagatggcctggtatgcgtaggtcacctgtgtttacactgatgaatgtgtgtggtttccctagtctgcatcattatattgagttgtgtggtgttggtagcacttgttactcaccctagaatgtgcctttctattgaaagacaagtagactaatagcttggcttcccagaaataaatgagacaattcacatgaaagcaattgcagttagacaaaatgacataaatattaaagattaagaataatattatttgtatctgtaatatacagaaatagtcaaaaaatacttggggctgcataatttgtggttgtagcagttgctgaatttagtcccatatagtgatttggttgcataatttaatgtttatgttgtatttgtttaatacatcactttcctgaatgaaatgattgtggtatgaagttataagaaataatgtctttggcttgttatagaaacagttattttagggattttttgtacttttgaagcagtttcaattacaagtcatttttcatgagttctgaagtaagttttaggcatttgttatgagatcatattattagcagcttagatgaaaatccaaaatgcatttatggatattttaattggaaaattaagtggatcttttataaaattaaatactctgctataatctcttagaaaaaataaatcccttttacctaataggcaagttcatgagaaatctgtaatgatatctctcaacatagcatgttaacttatagattatataattataaatttataagcctagtttatactaagtatattcaagttataagtcacaatacgtgaaatgaacataattctctgaatatgtcacattttttaaagatatctgtaatcccagcactttgggaggctgaggcaggtggatcacctgaggtcaggagttcaagaccagcccaaccaacatggcaaaaccctgtctctactaaaaatacaaaaaattagccaggtatggtggtgcacacctgtagtcccagctactcagaaggctgaggcaagacaatcacttgaactcgggagacagaggttgcagtgagtcgcgatggcaccactgcactccagccttggagacagagtgagactctgtctcaaaaaaaaaaaaaaaaaaaaagaaagaaaaatatatctttattttcaatattactgtcagtgcctgaaatcatgccttgttttgctttgtctacaaatatattctttcaaaaatcatccataatgaatatattttccattctaaggtgtacttcatttttggaaacagaaaaatgccaattatcatccatgcttgtgaatacagtaaataattgatctccctacatgttacctttttaaaataaattgaacatgaataatgagtctaatatagtacaacaggtgtttctgacaaatagtattggaaaatgtattgctatttgattttctatttatctgtgaagtccttttaaagatatccatgaaaactctctcttatgaatgtatggctaattgtaaagtagaatcctcataagaccagtattctatgatttcctcttgattaaataaaataaaatttaatgtgacaatggtttgtgtacttttctttccttgtcttctctgagcatctctctagaaataggaaaaaaaaatgggataggttttgtttgggtgatttccactgaagcatagcaaggtcatgcttttgtattgtctattatcagttataatttctcaaaaacagacagcaaacaggcagtgttcaaaaatttgtaatttactatcccgtgctaaagacaaaccacagagtaaaaccgcaacccggttaaccaccaaaacaaccttcaatcattctgactggttctgcatgtttcaacgtttatggtcttttggctgaaggccaaagttcatctcttattaccctttcttttccatctgtgaagatcattgcacacacactcgttctgcattccaaacaatttcacctggcaaaggaactaagtaaaactgtctctcatcttcattactattcatttcatctttcaaatcactgaatcgtgaaaattagaagtaacaaaaaaaagaaatcaggtgtattaaaaacaaaaatttgaaacagtatatctgtgaaaccgctcagtgttagaaattgtcactgatccatgtcaaattcagcaaacaaaactgaggcaatttactttcacattttactaaatggccacttgtaagcatacggatgagattttgtctttccccaggctggatcagtctgttggtttcccaaacagacaggggctgagtggcttaacaggtgtgccaatgtgagaaagaaacacaaaagcagctgttgttaaaggcgttaggtaggctttgccaagactttacctctcagatctcttctgtgaattgatgactaaagtatgtcaactttggaaaaatattcttgaaatattttccttgatttctgacttcaaaaggcaaattataaacaccttaatcaattaatatttactactagaatgattgcccaaaagactgaactaatcaagatagaaaacaaaagtattatggcttattatgtcaatctcctatttaaaaagcctcaacattttctcatagcctttagaagaaacaattttttgtacattgagatcccaattcaatgcctctttttgtccatatctcattgcaactttgactcatatgatatcactttgctgcaaacagattaagctactaatgaagacatgcaattatctttttgtcatctctctctctctgtagctctctctgtgtgtgtgaatacatgtatacttgctcaactaaaatgatcctcacagcctcacatattaagatctcatttattctcaatttgggcttgacttctaacaaaaactgttccttaactaatccaccaatagatggcatattcttctcctgagctttcatcctgtttatcatttacttggtattccaacctacctctatggcattgctttacagatctttaatgtggtctcgcattgatatggaaagtttgcttttgtagatttaacttatcatgtgagtcaatcaaagatttccaaatagttgatgaactttatgagagaaaaggcctgggttttctttctttgcctcccttcaggtacctggtggaggatgctatttctagtagctacttcaaaaaacaagttttctgagttgctctcttatttctttaaccacattgtctctgtcgttctctgtctctctgtttctctctttctctctctattcttttgcatggacaccaaattttgtctcttagattttgaccctcttatctttgaatactggttttgttctctaaactactagttttttgccataactgttttttctttgggattttggactgtatttcttagatctaaggtacagacctcctgcagggacttccatgaaccatatatccattgtagcaatgatcttcattgtcaaaaagagtctaattttaaaagcaaagatttgtcaaagaaaccttttagaatgcaaaatagctaggaattttaattctattaaatatcaacaataacaaaaaagtggtaactatgattattttctttttgacaaaataagttcatcattaaaaaaaccaataatgccaaatcctaaaaataaatttcagcctgtaaaacatacattcaagcatgtataaatatatgcatgtacaataaatatatttaaaataatttttaaatttctagactgttgactagtgagaaactagtgaaactatcgagagttgggaacattccgtgtaagggggtaatgaagttgagagtgataatggtacctctaacttatggctcagactgaggctagattcaccaactttgcatagcgtcctctgcatttagattttctattcaacattcttgcaatatcttgaatgaaggcatagaatggcagcacattaaatttacaaacggtaaagatcaaagaaggaataactgaaattattttgagagtgtggaattctgagctaagttatagtgctggtgtttgaacggagttttaatatgagttttgcctgttaggtgatttctgccaaaaaaaaaaaaaatacgaagtttgcattaatgaaagcagagtattcagctaaaaggaatattcatccttttcattttgaagtttgttattataccatatctggaatgttttgtttacttctgcatggacattttaaaaaaacattgaaacaggagacaatggcatgaaaaggatgatcagaaagatgaaacatttggaattgatgctttatgagggacattgaatatactggaagtatgtagtctaaagcagagaaggctaaagggagatatgatgcaaattcatgagaaatgttcatacctaatatttatgagtcaaatgctaagtataattctcatgactgatccagtgatgaggtaagtgtgtggacacagaaaactgtcacaatgcacagtgtgaaaagaataacagtagttcttacgtcagggtacaagtcgagaaaacgaatgcctctatggattacaggtggagagaaatgtgatctagggaaaaggggaaaggtggtattaggcagagattagaaggtgctgtagtttttgagctggagcctagaaccccacactctctcagcctctgagctgcagccacctcccctgcagctactggagacaccgcagccactaaggctgcaggacctcctgctactgaccgtgggtacttctggtggctgctgccagaaacccaatcccttgtttattctctgggtttcaattttacccccaaacctgatgaaataccgttggcaagggagtcttagaaattttagttttcttattctcagtgattaaagaaaagggcgcagagaagattatgggaatgttagaaggttagttagttaccatctagcacaaatgggattaagtgttagaggtctaggcaggatatatagagataaccaatttaaatggtcaaggaaggttaatatctataagtactttcaggcctgcctttggaaaggcagagtggagttctgtgttgctccagagagcaatagatgatagaagttattaggagatgaaatttaggtatttgtgaaaaataacttcctcataactagagctcatggcaaaaatgtcctgctattttaatatgttgggtgtttgagcaaaagtttaattctatttttttcagggattctctagaagagcttctcatagtaggcagtagatggtttagttggcagctaatgttccttaaaaatttacaattttatgattcccaaaccactcatctaaaaataacaaaatgtgtttaaagagtagattagttaatcacaaaacataaaaggtaactagccaaaagaattaaatatattcatcacgtcttaataactttgaggaaaatgagtacatgaggtgggaaacgaacattaaaggagtttcttatcagcccttttcaggattccaaacttttcttataaatatccatcagtgctccaattaagcctttggagtgatatgcaagaactccatagtggggagggaaaagtgcctccttccacacagatgttggcacagtgctgaaggatggcggctggccagcctgctttacaagtgagggccaggagcagcatctgcatatgagagcagattatcccattggcaaactccattaacactgccaagggcacggttatgctgttagtgactaagaagtcatccctttcacctgaacatacctctggtaatttagggtaataaagaggatgcctttcttttatatgcaagagaaataaagacttgaatggtaataagggagggcaatacatattcatttattatgtaagtaagaaaattcactggtaaataatctcataatatctaatgattggatgatatctaagcagtatgtcgatgatatctagtttatccaccattgaatcccttataaaacagaccagtcagctggtacccagtggtcttacatacagtcaaagatgggaagctcaggatccccacatgcagccaactggaagatgggatagcaaagtcagaaagacctgagttcaaatcttcactatgttggtcattaactatataaacttaagtattttatatcatcgagctaaatttcagtgtgtatacctttaagatagtaatgtgtacttcaaattgttgttacaaaattaaaagaggtaatgtgtataacagctatctcaataaatagcagatgttttaattccaatgtgcctacttcacactgttgttacaaaattaaaagagataatgcgtataacactatctcaataaatgggaggtgttattctatctttcagatgtctctaatggttagaaacgctttatattaaactgatttttttctctataatttaagcctgctaatcctcattatgacttaagggcttcttaaaacaaatgttatatcttttatcttttactgaaagtctttcacatatttgaaaataagaatcgttaacttcactcatcatttcttttatggactgaacacacccagtccctcaacctttccttgtattccgtggctcttagccacctcaccatagcaagaagtgaggcggggaatgtggaaggattgtgattaagtggttgaagtgcagagataaggatgggaaatgcagggtaaaaagcactggaacaggcccagctttgttttttggccaaaagattcagcagctctgatcggcttactgatattcacacggtgctgaggttggcatttttccagaggcattaagcatcattccactcacggttgacagtttccagaaaggtttctcccaaaaacacactctcctttgatttcttcctgaaaatcatgtatctggtactttatcattttagctcatatatccacaggcagccctgggtgaaaccacactttcactaattttaatcatctatacttaagggcttttaggttttttttttaattgggttcattaaatcatactttaatgcattgaaattcaccattttcatgtgtacggttctacgaattttggcaaaggtatgcagtcatgtaaccactgcccccaaaaggacccccatgctccgatgtaatcaatattctcccccaatccttaacccctggtcaccactgttttgctttctgtctctgtagttggaccttttctagaatgtcacataaatgaaactatatagtttgtacccatgctatttctgcttctttcatttaatatgatgctcttgagactgtaagttgtatagcatgtatcagtagttcccttttttgcagagaatttttccattgtatcataatttatgtatgtgccagagttgtttgcttatccactcactaggggatgaacattggagagtttttctttttctttctttctttctttcttttttttttttaaataaagctgcaataagcttccatgtacagatcattgtgtaggcacatgtattcattattgttgggtaacaatgttggagtaaatggctgggtaggatggtatatgttcatttttgtatgtttaattttatgagaaaataacaaacatggttataccattttgcatttctagccaaaaaatataaaagttttagctgctttgcatatttgtcagcaattggtattgtctcttttaaatacagccattttcataggtgtagtgtttttttaatgtagttttaaactgtaattcactcatggtcaatgatgccgaacatttttcatgtgtgtgtttgccatccttatctgccatccttatcttttctttggggaagacagttcagttcgttttctctccttttttttttttagacggagtcttgctctttgtcacccgggctggagtgcaatggcacgacctgggctcattgaaacctccacctcccgggttcaagcgattctcttgccttcgccacccgagtagctggaattataggcgcccgccaccacgcctggctagtttttctatttttagcagagatgaggttttaccatattggccaggctggcctccactccggacctcagttgatccgcccacctcggcctcccaaagtgttcagattgcaggcgtcagccactgcacccagcccagtttgttttgttttgttttgtttattggtttgttttctattattgagttcattatattcattatacataatttgcacaccagtccttaattatataggtttttttgcaaatattttccccacactgtggtttattttttatattttaacagggtctttcaaatagaatgttttaatttttatttatcagtgtttttcctgaccagtttgtattttttatgccatataaaatatctttgtgtaaaagatgtcacaaatattttctcctccattttctttgataatttttgtagttacatattttacatttaggtctatgattcattttaagttggttgagtctttttctgcatatgcatatgtaattgaacatttttttaaataccatattttctccttttaattgccttagtgccttcatgagaaatcaactgaccttatatttgcgagtctgtatccagacactctagtctattatttcctttgtctatatttatgtccttttgcaaacaccaaattgtcttcattgcataacattagaataactacagaaatcagagccgggtgcagtggcttatgcctggaattccagcactttggaaggctaaggcgggcggatcacctgaggtcaggagttcgagaccagcctggccaatatggtgaaatcccatctttaataaaaatacaaataatagccggctgtggtggtgcatgcctgtaaccacagctacttgggtggctgaggcaggagaatcacttaaacccgggaggcagaggttgcagtgagccaagatcagccattgcacctcagcctgggcaacaagagtgaaactccatctcaaaaaaaaaaaaaaaaaaaaagaaagaaagaaaaagaaaggaaaaaaaaagaaatcagttaatgtgagtcctccttagttgtttcactttctcattttttttttaattccattctagatcccttgcttttccatataacctttagaatagctggatcatatttgagattgcattgaatgtataattcagtttggaggataattgacaatctaacaatattgagtcttcccaaatatcggtctattatatagctccatttatttaggccttttaaatttatctcttttatgttttgcatttttaagcccacatattttgtatatattttcttcgctttaatttttgtttgtattttaaactgtactttttccctcatttgatcatgaattgttatttctaatataaagaaacataatggaatactttttgtatcctatgaccttggtatactcactagttttagcagcttttctgtaaagtgtttgggattttctatatacgccaccatgtctactgtgaataaagaaaattttatgtttgctcctttccaatctatatgccccaattttttatttattcatttatttatttatttttgtagagttattacattgattaggacctctaggtgaatgtggtaaaagcaagcctccctgctttcttcccagtcttaggggaaaaacgttcagtcttttcccagtaagtatgttacctgcaggcttttgtagatactgtttatcaggttgaagaagttcttttctattaccagtttgctagggtttttattataagtgactattgaattctgttaaatcatttttatcatgcgtaaagatgagcatatactttctcttcttagtttgttgttacaataaattccttttttttttttttttttttttttggcacagtctcactctgtcgcccaggttggtgtgcagtggcatgatctcgggtcactgcaacctccgcctccggagttcaagtgattctcgtgcctcatcttcccgagcagctaggactacaggcacgtgccaccatgccgggctaattttgtattttcagtagggatgggtttttgccatgttggccagactggtctcaatctcctgaccttaaacaatctgcccatctcagcctcccaaagtgctgggattaccggcgtgacccaccatgcccagccccatggattggtttttgaatataaaatcaacactgcattccggacaaaactccacttggtatgatacactaaatgttttatatattgctggatgtgatatgtaaggatttttgtattcatattcatgaaatatattgatctgtagttttctttaacataatttctccacaaggttttctatgtactaatggtggctcataaaatgaattggaaattctttttctttattgttagcaagattgtttagaggtagtaatatttcttccttcagtgttggaaaaaattcactattgaagtcatttgaacctcaagtttacttttttgcaagaagttaaaccaataatttatttttttaaatagatataggactatttaggctgtttcttcttcagtaaatattagtttgtatctttgcatgtgtcgacttcatccaagttgttgaatttggggagcataaattggttaatagtactctcttgttatcctttttgttttgttttgttttgtttgagatggagtcttgctctcgcccagctggagtgcagtggtcagatgttggctcactgcaacttctacctcccaggttcaagcgcttctcgtgccttagccttccgagtagctgggattacaggcacccaccacaatacccggctgatttttggatttttagtagcgacggggtttcaccatgtgggccaggctggtcttgaactcctgacctcaggtgatctgcccatcttggcctcccaaaatgttgggattacaggcgtgagccaccgcgcccggcgtcttgctatcctgacatttatcattcctttctctctctttctgtcagtaatctggataacgatttattactattattgattgttacaaagaatcagctttaagtttcacttattttctctattattttaatctgttttcaagttataatttccctgtgactatgtctttgacccttgggtaatttagaagtctgttctgtaattttttgttttgtttgtttttcatgtttggggtttttaagatacatttcggctgggtgcagtggctcatgcctgtaatcccagcactttgggaggctgaggcgggtggatcacctgaggtctggagttcaggaccagtctggccaacatggtgaaaccccatctctactaaaaatacaaaattagccaaatgtggtggcgcatgcctgtagtcccagctactcgggaggctgagacaggagaatcgcttaaacccaggaggcggaggtggcagtgagccgagactgtgccattgcactccagcctgggctatggagtgagactctgtctcattaaaaaaaaaaaaaaatacattttgtaactgatttctatttttaattttataacacttttaaaattatattgtcttaaactgacataaaaatatttatgtataatatgtaaattattacaaagtgatgcttcagtacatatactgtatattaatcagaatgggataattagcatacccatcatctcaaacctttgtcattacattatgttgggaacattcaatatcccccttttagctatttgaaactataaagtatatgattattaactataatcatcctaaagtggtatagaacactagaacttattcttctcatctagcagtaatattgtatcctttgataaatctctccctctctctccctgttccctaccctttccagcctctagtgtcttctattatactttttacttttatgaggtcggctatttttagcatccatatttgagtgagaatatgtagtgtttaaggatcctgttcctggcttatgtcacttaacatagtatctattagttctatatacgttgccacaaatgacagaatttcactgtttgtttatggctaaatagtattctgttgtgtatatacaccacattttctttatccattcttctcttattggacgcctaagttgattccgtatcttggccattgtgaatagtgctgcaatagacatagagatgcagatgtctttttgatatactcatttcatctcctttgggtaaatgccaagtagtgggattgctggatcatattatagttctatttgtaatttttgaggaacctctatactcttctccactttggctgaactagtttacattcccaccaacagtgtatatgagttctgttttctccacatcctttcaagcattggttacgttttgtctttttgataatagccatcctaactggggtcagatgctatcacattgtggttttaatttgtatttccctgaggactagtggtgttgagcatttttcatttgttgcatatacatgtcttcttttgagaaacatcagttcagatcatttgcccattttttaatcaagttgttttgctgtttagatgtttgagttttttgtgtattctagatgtgaatcccttgtcagatgtagagtttgcaaatattttatctcattctgtaggttgtctttcagtctgattgtttcttttgctgtgcagaagctttttagtttgatatgataccatttgtttatttttgcttttgttgttgtacttttgaggaactttttgttactcataaaatattttccagaccagtgtcttgaagaatttatgctctttgcctccagagatcttataatttcaggtcttatatcttggtctttgttctattttgagttgagctttgtatgtggtgagaggtgggggattagttactttctgcaggagatactcagttatcccagtaccatttattgaagagcctgtcctttcctcaattagtgttttcagtacatttgtcaaaaaatcaattggctgtagatacacagattagtttttgcattctgtattttgttccattagcctatagatgtttctatgccagtaccatgctgttttggttactatggctttgtagtatatttttaaatctggtaatatgatgcttccatatttattttgttcaggatttatttggctatttgggtcttttgtggtttcatacaaattttaggattttttttctatttctgtggagtgtcgtttgtatttttatagagaaggcattcactccacagattcttttcgatagtatggccattttaacaatgttaattcttctgatacatgagtatgatgtatctttctgttcatttgtatcctcttcagttttttcatcagtgttttgcagttttccttttaaaggttttgtacctccttggataaattcacttttaggtttcctctttttttttttgtacactattataaattggactgtcttcttgatctcttttttttagtttgttgcttgtgtatagaaatgctatggattttcgtgtgtcgattttttattctgcaattttactgaattggtttatcagctctaagagtttttcagtagaatctttaggtttttctatatataggatcatgtcatctgcagacaggaacaatttcacttcattcatttgaatgtggatgccctttaattttcatttcccaattgctctggctgggacttctagttctatattgagtgcaagtggtgagtgttagcatctttgtcttttttccagttctgagaggaaaagattttagcttttgcttctttggtgtgatgttaattgtgtgtttgtaatatgtgccttttattattttgaggtaatttccttctacacctattttattgagatttttaatataatggcatattacattgtattaaatgttttttctgaatctatcaaaatgattgtatttttgtctttaattatattgatttaatgtatgatgtttattgatttgtgtatattaaaccatcctcacattcctggcataaatgccacttgattatgttgtattatctttgtgatctgtgctggatttagcttgctagtattttcttgaagattttgcatctgtatttgtcagaggtattggcctgtaattttcctgtgtgtgtgtgtgtgtgtgtgtgtgtgtgtgtgtgtgtgtgtgtccttatctggttttgttattagatttagactgggcttgcagaatgagtttggaagaattccctcggcttcaattttttgaaatagtttgagaatgatttgtattaattctccttcatagattgaatagaatccagtgatgaagccatccagttaagtacttttcttttttgtgagactttttattactgattcaatcatgttacttattattggtctattcaggttttctccttcttcctggtccaatcttggtaagttatgtgtctaagaatttatccacatcctctaggttttcaactaggttttcagttggtgtatagttgttcatagtagtctctagtgatcctttgtattatgtggtatttgttatgatgcctcctttttcatttatgatttttatttgggttttctttctcactttattgctagttagcccatattgtatgatttcaatcattttaattcttttcaaattcattttttgtctcagaatatggtctatgttgttaaatatttcatgtgtacctgaaagtatatttttctgttcctgcatattctataaatatcaaataaatggatacaataatactttcctgataatatattttgaatgattcaggaaaacttaagaaacgtaagggttaattatgccactaattaaaaaattcagaaactttatgacaactttcatctctcatagccactttgactgcacagtggctttgttctcaaagccttgaaattgagttattgggatgtagtagaagcagtttgaagaacaggcagtaagcccaccttctccattagtatgttctatttactttgacatggagattttgcagtagtttgacacaaatctgaatagaaacctatttaatttcagacttctttacccactcttagaatttttcttttgatagcagataaggattaagtaatatacacaggagacagtctaagaagcatatttatttaaatataactttgttataacatcaattgcgtgtaaccaatctcatgccaaaaacaaatgcaaaaattctgttgcttaggattttactttatgtgttttaagtatatattgaaatgtacttcagaacatgtgctttttaaaatttatccaactttggtaattttggtttttgaacatcccgtagatacctaaaggactcctttggagcagcagtgctatatggatcacacttcaaaagtgtaattctggggcagcaatatgaaggtcaaaacatctccctccaactaggaactggatatttaaaagaggttaaggaaatttgatgcactgtattaaaaattgtttcaacctttttttaaactttagtgtaagtactacaacattttactaagcaaatttggagttctaatttaaccgttttttcatgttctttatcttagattctgaggacaaaaagcaatgaacacagctttttagtagctatttcctttcaaactctctggagagcaatcaaattttgtaatctgtaaaagaacatacattaatgttttgttcaaagagaattcaatctataataggccttttaaagaaatatgtataaaggcccgctgtctgtcctttttgatattttagtgtatgtatttgttcagtgtagttttgtttctttttaagaagctaatattttaggaagaaccagatactactaggccaagtacattctttttgtgtaactagaaatttcaggtcttttagttttccccaggcaacatctgctaagaacatagcattagttacatactgcttggaccaaccccatctttgaatatcacttgtagacatagtcacctaaagaagcaactaaacgttgacctaggggtccactttggcaattttgcctgcacctcattccagcgtatgccatggactttttttctgtttatgaagaacgtagccagagatagtcctaaaatagaagctaagggaaaaaaacaaaactctcacttctagatgtgcgaactctagcaaaaaaaaagttttaaaattctgccctgtttatagtcttatagacagactcggattaaaaaatatactttaactgctttatttcataataaaacagagacttttccacaaacttgggaagtgaatagaagcaatccactttaatgtattcctcagaatgagtatattctcacgtctcaacttaacaggatattccacatgtctatgttgatcccatcactctcaattacacaaggagaccagtactgccacaattccaagccagagggagcagtccatctttcacagccaagggaaggactggagtgagaggaccattctcactatagtcatagctagccactcccacactggcaactgaggctttgctccgcccagtctggtagactacacttttctattcctaagatccctgtcttattcatgtacaagagttttgagagaaggcaaccccattcccttaatattaagtttaattatacagtttccacctgttcacttcaatagtggtaattcttaggacctagcactcccagtttataaacacaacgaacttcaaaggtgccatccagctcctcaaattcttgaccaggacagcttatctcagagttagaaaactcccaacccttctctctagaaatgtcttcattacattaagagacttttcttcttaaactgtaaaaacaaaacaaaagtaactgattagtatcctctttctctagacagtgaagtcattagtctactcctggaggccaccatgagttacataggaggtttcccaagacccatcacctgtgtgaaggtctatatacctagactttggaaaggaatgaaaataagaggcaagctacttttagtctctgtctttgctatcatactcttcctttaaactatttctctctatcccacctctgtctctttctttttctgtctccctgtttctctctttttttgtcactcacacacacacacacacacacacggacacacatatacaaaagcaaccctgtaaaaatcactgcttgtgtaaagcctaaaccataattggggttagaatttggagctccactagttacgcagagaatgatttctgtgggttcttaactttctaagcttcaaatttcccatacataaaagtgatagtctaataattgtgaactcaaaaattttgtgataaataagttaaataattcctatacagccttcaggacaatgcctaaaccagaataaaaataaagataatgataatttagccttatatttctccttccattttagtcaaaatatttttaccaatccacagatacagtattctctttcttttcttttcttttttttattttgtttttatttttatttttttttgatggagtctaactctgtcacccagactgaagtgcaatgttgtgatctcagatcactgcaacctccgccgcctgggttcaagcgattctcctgcttcagcctcccgagtagttgggattacaggtgcctgccactgcacccaaataatttttgtatttttagtagagacggggtttcaccatcttggccaggctggtcttgaactcctgacctcatgatctacccacctcggcctcccaaagtgctgggattacaggcatgagccactacacccggctagtagtattctcattttatctgaggttatctccacattgcacacacccatcagagatgctctctctcatcctggtgaaacataaccattccaaaacgcagtgaccgttcactcttcagcaaatctttcttagttgaaatagccctcactgcttccctttttctcttattcttacacacatctcaaaatcagttctctattagttccaggagttgtttccttgtccttcgagtaattctacatagacaatcatgttatctgtgaacaaagacacagctccaagggtgagaacgggagctttaaaatttcttaaagctcatgcctatagaagtcattcagtgccatctctgcatctgcatgcattctcttggccaaaacaagtcataggaccagtgtagattaaagatgtgagactgcgggagaggagaaacacggcaaagtcacatcacaaaaaaccacttggaatgggaacacgggttatcctcctttttgaaaacaaactgtgtcactaatattgtcagtcttattattacactcaaatggattacaagatccctaagagtaaaaagccatagttttagtatttctcaaataggtacaatgcactgtaatgttggaatgtgtctttagaaagataaaataaccaaacaatcataacacattattctcaaaacttattttatatttttgttttaatgtgtacaattgcaatctcatatttgtgttagaatcatttgtttttgtgtcttcatgtttctataagataggaccaatattctttattgggctttgattttattttgtaacttaaatgtattaaggcaataaatgtaattttccacttaaaactatcattatagatttggttactacctactgctcagcaattttttttcttatcaaaattcttcctggttggtttacttctcattttttttccattaaatgatataaattttaagatagtagtttttcttgttacattagttcagaatcatagattcatgcataatagctttgatattcaaataaccttcattggtcttgatacttttataattttcatttcagaatcccttattgccttccattgaattcttctggtttgtgttataacatttcctgtaatttgtaagcaatccattctgttttcaaaatcacttgtgtgtaaatttttctcattaccatgttcatttcagttttaactaaagttcactcataatatgtcatacataaagaaacacttaaaatatattagaactatttacattctatatataatagttatgccagaaacgaaacagaaatgttgaattaagtttagcctaaagatgctgtcttatgtgttttaagtttggcctaaaggtttttccatacatagtgaactgtaacctaactggatgtgtaaacagagtatagcctactcttgtaacaagtagccaagtctcatcccattacgacaaccatacttcaatcacacacagggtccacctgttcaaactgtgtttgaataagccagacaccagctgtaaccaatctggctgtttctgtgcctcacttccgttttctctatgtagctttcctttgtccatacatcctttccaaacctgcagtggagcaccatgctcagctaattcttaatttttttttctagagatagaggtcttgctgatttgcccaggctggtctcaaagtagtggcttcaagagatcttcccaccccagcctcccaaagtgctggggttataggcatgagccattgcacctgctggagcactaatttctaaacaaacaaacccaagatcaaattagccagtcagagtgtgtcctacttacattctgtacataaccctactaaaacctttatgtacttactgttatgaatacttttagttcgtccctggcagaggtgctaaatttcattccctgatatttagcatgatgtcaccaaatcgtagttgtttaataaacatttgcgtaatgaaagactgactgaatgaatgcatgaagtaactatcagctacaactactaaactaacatgaccaagattcaaaggaaactttctaaaatcttcaaaaatctaagttctagtgctctttcaagacctcagaactgccttagagagtttaatggaaataacatacataggagtatggggaaaagtgctatttacttagcaactatgtgtcagacattttataagtagtgtcttacgtactttcttagtaatattttgaagtattagtagatagcatttatctaattttagaaataagaaaatggaggtgggctaataagttgtttaagattccaaacattctgtagtaaaaccagtattgatcctaatttgatggactttaaacctgctgagcctctgtctggtggaggaaaaaaaaaattaaaaaaaaaagcatttttcttccttcttaggttcagtggctgaggcctgtgaattatactgacaaaagagagattatcaagaataaatatttatttgatgtgtaggggctggggaggaacaggggcagctcacataaaagcaaggaataccccaaagaggcagttggacccgggccctgtatcccattttaacaaagtgtgataaagtgtggggaagagactagataaagaaaaggagggtttaatccctgggtggccggagtaggttgtgggaaaatgactaggaaatgtgtagtaaataagggctatttagtaaggtttgttatgcaaccttaaggcatctcaggtggtgacttattcacttctccctgatataagaaagtaggacacctttacaggtataagtttcctttacaaccagaaaattcatgccttgctgaagacagttcatcttgtgtttgctatttctaattgccttcagcttaaaatactccttatgctaaagtggcatattttggggtagcatattctgatctctttcaccccaaccaacaagactgtggctgttggcaggcaaacattacatcttatttatttacacttctctgatgtctgtaacagtgcatagcacagagtaggtatccagtagatgtttgagaaaaaaaaaataataaatgggataattaacatttttggcttctaggagattattttcattccaaattggccttctcccgctgttttttcccctcatactggtgacataccctcctgtttggtcagaaagaattctgatcttggatcatctgaaatacatttactaaaaaaacctgatatgtatttacatattgaaagcacatctgacttaacatttaggagcatgggctagcaatcttactagtttcaagccttggctccaccaagtgacttgctctatgaccttaggtttcatagcctcttaagtctcagctattttattttaaatgatgggcaaggctttttgctgtttggtttacttataagtcctgagtgcctgaaacaaaataagtattcagtatgtttggttgaataagtgaatgccatgtagtacctattttggttgtcattggctttaaagaggtgaatatactttaagtggttcaagagctcccacaccataggagcttaataaatgttagccattttattatgtaagtataacccttcacacactttcactagtcatttgttataacattgactttttcaaaagttctgtggaaatgagttataagactatccattgttgaaggcaatgttcttagttgtattcattgttatcaatttagtcattaaaaaacatttgctttccttatcaatacatatgcttcattttattagtaagtagaatttcataacccatcctgttttccatttctcttgcatactaggaaacacaaagtgaaatttggttctcgagctagttcagtcacataatgttgttggtaaaattatctataacatttggattcttttggatataaatttgcccttgataggctaagctatattatattttctataatcttgtgttctataatattctaaaatatcgttctgtaattattttatgagaaacattcttcataaatatgaaatgtatatcataaatcagtttgtttatgatatacatgtttttcatgtaatttaatgatttaattgtaattatcaataaatatgcgaaatctaaacattcattggcaaatatagtagaaactataatgaattggctatagtgtttctcatgttagacattgttgacctaaaaagaagaaactgaggtgaaattaatggagtgtttatctgggcaaagcttgaagattacaacctgggagcattgattcaagttttcctaaatgtacactccaatttgtggcagctacaagtgtttgtgttcttttttttaataatttcaactttcattttagataccgggagtatatgtgcgggtttgtaaacatgtgtatattaagtgatgtggaggtttggggtacagatcccatcacacaggtagtaagcatagcacctgtagtagtctgttttcatgctgctaataaagacgtacctgagaatgggtatttataaagaaaaagagatttaatggactctcagttctacatggctagggaagcctcacaataatggaagaaagcaaaaggctcatcttacatggtggcaggcaagagagaatgagagccaagcaaaagaggaaatcctttataaaaccatcagatctcatgagactttttcactaccatgagaacagtatgggggaaactgcccccatgattcaattatctcctactgggtccctcccacaacacatgggaattatgggagctacagttcaagatgagatttgggtgggtcacagccaaaccatattggcacttctacactaaaaagtatccaagacaagtctcaatcaatttagaggtttattttgcaaggttaaggacatgcccatcacacaacctcaggaggtcctgagaacatgtgcccaaggtggttgggctacaacttggttttatacatttagggagacatgagacatcaatcaatatgtattaggtatatagtggttcagtctgaaaaggtgaagtgagggacttccatgttatacgtggaactggaagtgggggaagtgggaggcttccaaactggaagtggggttcttccaggttataggtggatacaaaggttttctgattggcaattggttattatctaaagacctggaatgcatagaaaggaatatcttgtttgtgataaggggttatagagaccaaggtttgatcatgcagacaaaacctcaaggtagcaggattcagagagaatagattgtaaatgtttcttatggaacttaaagagtcacttctattggtcttgaggtctgcattggtggtaacaaggcatattttcaggttaccttcggaatgcccttggctgagaagaggggtctattcagatgactgggggccttagaattttatttttggtttacatatccaataggtagcctttcagcccacagtgccctccctctctctgtcctctagcagttcacagtgtctgttgttccgaggagtgcccaatgtttagctccttgttataagtgagaacatgctatagttggtgattttttttttttaggagaaagaggcagttcctgaattgtttactaagaatttacataaaaatagcttaagctattgattagctatacgttgttctctatatcagaaattccagaaacaagaggataaggggtgaagcagctaatcaggaacaaaatgaattgaaataattgcccccagacgtgggtgcaggggttgggatgtggagtgttggagggtgaaggcatgactgatgtcccacgctcatatctctctgggcctgcatacctcgcatagttcatgctattctgagctattttacttttctcaacatttagatatttgactatagaaatgcttataaatataatttatacacatataaatggcatgtttgttatttatttagtttgagctggagacttgctctgtcacccaggctggagtaggagtacagtggcacaaatcttggctcactgcaacctctgcctcccaggttcaagcaattctcctgcctcagcctcctgagtagctgggattttaggcgaccaccgccacacctagctaatttttgtatttttagtaaatatggggtctcaccacgttggccgggctggtttagtctcaagctcctgccctcaagtgatccaccaacctcagcctccaaaagtgctggaattacaggcatcagctaccacacccagccataatgtcatatttattaccttaattatgatatttataattttcaaatgcagtcttttaaagcaaaatcaagagatattcaaggacctttgaaaatgcaaaacaattatttatatttttaatgtgccttagaaatagctcaatttacactgtcgaaaatttgcatatataatttagtaaggaataattccacagtactcagtaggacctattaggtttcactagaataatttatattagtaagtcacaaattaatgcttatggacttttcaaaagtttatgtgtttcaagagaaagctaactttgcaaaaagggtttatgaaatcatctaattaattcatacattataaaaaccacattaacaatctctcaattttctttcctccttttgtatagacaattaatatagaacattttaaaatagactatttgaatattgaaaatccaattacaggtaaagtaggtggagtaatttgaaattgcattctaatacttataataaataatttgttttcagatcataaattgcttactataaagcttttctaacacttataaaatttatggcaacttgagtatttgactcatcatgtcacttttcaggattgtctttctttttcaggaatattaggtgttctttgttttaacttttaagttcaggagtacaagtgcaactttgttacataggtaaacttgtgtcttggaggcctgttgtatagattatttcatcacctaaatattaagcctagtacccattagttattatttctgatcctcttcctcctcccaccctcagccttctgataggccctagtgtgtattgttccctttatgtgcccatgtgttcccatcatttagcttccacttacaagtgagaacagaggcagtgtttggttttctgttcttgtattagtttgctaaggattatggcctctagctccatccatatccatgcaaaggacatgatcttgtttcttttttttttttttttttttggagacagagtctcacattgtcctgttgccaaggctggagtgcagtggctcgatctcggctcactgcaacttccacctcccaggttcaagcaattctcctgcctcagcctcctgagtggctgggattacaggcgcccgccaacacgcccagctaattttttgtatttttagtagagatggggtttcactatgttggccaggctggtctcgaacgcctgacctcatgatccgcctgccttggcctcccaaagtgctaggattacaggcgtgagccaccgtgcccggctgatcttgtttctttctctcccttccttcctcctttcctttctctgtcttcattctgcatttatctttccctcttttctctgttaatctctttcccttcgtttcttctttcttttctcttttgcctgtattcccaattatagcggtaacattacttgacttcaattgatgggacttttacagtttaaatctttatacttatttatattccaaattaattataagacattcttttttttaagacattctaaactactttttgccttgaaatgtcagtaagaataatatctaagaaatgtgtcctattttagtcatataaaacaaatgtatcaatttacatttatattttcatttaaaaatacatatgtagaacatgttatgtgtcagaaaccatccttagaagcacttctaaaatgtagcggatttaattgtcatcattaaattattaaataagcataccttattcatttcagttaggtattattattatgaccactttatacatgaggacttaaggctcaatgaattaggtgattttgtcaagggcagttcgtttgtgagcaatagaatcaagattcaaacctagacttttggattatgtaaccacatgttatgtgtggagggaaatttaaaaaacaaaacaaaaactccagacaccaaaaagcaaacaaaacccctaaacaaaagctaaaagctgaattctgttctttagactatgtctaaatattatctgtcagtttttacacctcttttttcttaacagatgactggagggagtgttgtattatagtataatggaaaaccttcataaccttgattacagcagctgaagaactcttgagagagaaaaaaggaagatagagttttgcctcattctctccttatttagtgttctcagaagtcattcttaatcttttacctcaattatccttagttcatttatgaaaaaatacaaaccattcaaaccctctgtcatatcatagcgtatgtgtgacttgactttatgagtgaaggctttctgtacgtgtgttctgaaataaaagcttaatgaaaacatctatttccttttctgcagtgtgcagatgataataacgaagcatgtggcaatgctacagcagttatagtcacatggatccgggacatactagaaagaaacatgtcactgatccatgggcctgtaagtgacacaagcaaaggcattcttacataggttcactgcatctattatttatctgatagaacatgtgtgaaggtgttacaagagtgctggacttaatatggattactgtggaacttcctatcaaagctgatgagatgaatactaaaaaaaggttaatcaaagtttgacactggcccttacagaagccagagctactaatttccaaatgctacaacttttgaatactctaaaataatcctagtggcagtgtcaacagagtgctatgggaaaagaaagtgcggaggatcagtgttggcttaggggcctcagaaagcgtcacagaaaaaatgattgtttattgcagagaaaggagagaaatcaaacagggtgcaacaagtgctaagtcatggcttgtccagaatactttagaacttcctgtatagttgagtcttgccttttgggagacaggaggggttgggaaagctaggattacaaataaaattggtgatattcagattatagttgctttgagaatatgcagttatttgggggtgtttagaaatggtgttattcatggacacatagagggaaacaagacacacagggtcctgtgggtggggggtggagggtggagggtggcagggtggcggggggagagggtagagggtggaaggtggcagggagaagggtggggagtgggagggtgggaggggtgggagggtggtgggggagggagatgggagggtggggggaggtggagagtgaaagggtggtgggggatgggagggggtgggaaaggggagagtgggagggtggagattgggagaaaagagaggaatgggaaaaataactaaaagtaattgggtactaggcttaatacctggatgatgatataatctgtacaacaaacctccatggcacaagtttacctatgtaagaaacctgtacccctgaacataaaataaaggtttgaaagattaagtgccttgctaaaagttagagaatatgttaatgtgttatattcagaaagtaagagcttctaatgctttctactcccttccccacaataattatgctagttttctattcatcatctctatctaagtattccacatagtatttcaggttaatgaatatttttatatctcctatttccagataaaaccatataaagttctctcaggtcagacgcacagaaacacatgtataagctacatcatcatatatcatcactttggtgttttaagtcatagaaccattgctcactgtagaacaagacagcaaaaatgatgctttatgaaaacagaaagtaaatttcacatctatcattcatcttataaattctttgtatcaaaattttaattaattagagtgacctagtttcctcactgtggaagaacaatatatgtatatacgtatgtatatgtatatatatatatttttaatgtaagtactctctcatccaggaaatgttccctgttgagtgataagcctagtgtgagaacataacgttcagccagcaaaggttatattacattaatctttgtacactgctcaatagttaagaggtttggaaccgtttatagtaaggaccatgctatcaggttttatcagtggcttattacataggtgacaatcaaaacattattgccaaacttcatgttagttcacagatttaatatctaatatacattttacagttatttgaggcaagttaccttcatttctgggttgcacacgtatcactgggagaaaatgcaaagtacataccagagaagaggtgagttccctttttcaagcagtgcaaaccacagaaaaacatcaagcaaaagatctaatgtaactctgttgtgaaaagagttgtacaagttgtactagtaactaaaatacacctagaagaaaaaagatttttggtcaacagacatttcagggcaaagatatttgcattgctaagcagaaatacattatgcataatcggttaatagataaggaagaaaaattcaatattaaagaccttcttttgtacccaatgtattataatctgagctagatgtgttccatgcactggattgtttcatcctggtagtaatttataggtgggcattatcgtctcagttattatgaatacatactactgacatggcagaactgctattctgtcaccctcacattaatctctctctacttcctgtgtttgtatacatatataacattgtatataaagtctttttcttttttttgagacagagtctctctctgacactgaggctggagtgcagtggcaggatctcagctcactgcaacccccgcctcccaggttcaaatgattctcttgcctcagctttgccagtagctgggattacaggcacctgccaccatgccagctgatttttgtatttttaatacagatggggttacaccatgttggccaggctggtctcaacctcctgacctcaggtgatatgcctgcctcggtctcccaaagtgctgggattacaggcatgagccaccatgcacggccaagtcgttacctaaaatatttcagtgatttggcggggagtgggaatccttgttgcttaatattttcctcaataaaagtgtcaaatggttaatctctttatagattatcttccttttgatatttataataattatatttgaaactctcagaagaccagatgaactcaaactacagtgccacaagagacattggaaattctgtgtgtcataccggacattaattatatttcaaataacaggaattcctttaaacaggctgaaacaataaacatacaaagagtttactcagcatttattgtgtgttgtgcatttgtatgtttgttcaatgagtcacttaccccataggagaagtttagtcacaggatttttcagaaagcctaagagggtcatgaatgaaaatatcctcctattaagatattaagcctatcacatgtggcatataagtgatgtgaaattcatgctcttaagtgatgtatttcaaaggacagcctgtttcaaggtatggtaaaatgatatatgtacaaatattgccctgtgggtgtgtagaactgaggctcttaatgacactttgacgatttgtgagactcttgccatcctgtaaatagtcatagcagctacacctttcactggaaacagggaattttcccaagatctgtctctcaccttctggttcaaaaattcttgctctcctttgacaagcccgtctcttgggttacggctctctctctagcaaatcctccagaggataacaggagagtctgtgcactgactttcagaggttcccttgatccattgcttttgagctgaatctaatgccatagtgcagaaccttacactggacctgttgccccatgattttgattcccagaagtggagatgttggctaccataccatattccaaaatataagatgagttcacaaaccagctgaagaactcacgaggaagtgtcagggcaaaggcaactttaagaactgctgttttcgatgagctaagtgagaataaaacaaaaattcccctatttatgtatcaatagctatgcactgacagtttttacaagtgtaattatacacaagcaaatggaggtaaaaaatcaaaatatcctccagaaccagatattcttgaatttaaagacttatttgactactctaaatctctgaaaacacttctagtattcaaaaatgtggcataacttatgtgggccaactaaactagaaaatggtgagttttaatatttatatgatgacaagatcaccatgacagaatagaatgttcccaaaacagcttcgagcaataatagatccagcgcaaaaaaaaaaaaaaaaaaaagctggaggatttagctctgccagttattgactatgtgacctggtgcaattactattattacctatttgacattttcaaatcacatgacttacttcacaagtaagaacaccaatgtccctaccgaggtttgttttcaaagaatcaggaaacccaactccagaaagtgctattcatactgttttcatgaatggtgctccgtgaccttgataacatatgtccctagagctgtaagccatggatttggctttcagatggtgtcaattaaataatgtaagctaaagagccacagattttaaaatgttacataaatcttactgagaaagtgattaaaaataatcatcttcaagctcacaccaaatgacagttaatacagagtattttagtcctcataaataataaaaacaagaatgatgcacaggtaccattattttcaacattgttctaaagatgaagaaattaaggtatagggattacacatctagatagtggaggagtgaattttgaaacccaaacgagttgacataaaagaatgacaaccttttaactgccaagctgtatccactatcatgccgatttcaaaggatagcatggtattgtgccgctttattttttgtaaaagaaccaacaatacatgcaacttgaaacattcctatagatagatgattttatgattgccagggtgtttgagatgacacacaaacaacatgcatctcagattactgaatagaacagagaattgcatggacatatatgaacattatgtatcattagggttttggttcatctttcaagtcaagctggtacaggctggttgacatttcctggtaaaagggtgggagaaccaaaaaaatacatcctttctcagatatgacttttgtgactatcttgagaagaagaatccatgcccgatttatctctgcatttctgttttcacacagaacaaataagtgctgaataaagtttatttgaatgaaaaacaagcctacgtagtaataacaatgtggaaaggagtaattattctgtcctgaggtgcaaaagatggtttaaaaaggtttctaggtgaattagaaaaaaaaaatgcttttgacatctaagacatgtgtatatccattttccttactgatatattttctattaaacttagaaataattatctgcctaatggaaagaactgtttataattgatgtatgtgaaaatgagctgaaagaggaaaacattcagtctatatctctacagttatgtgttcaatggtagtattgatactagcaaatgtatttggttcttctactttgtttaatctatttaataacacttagtgtaatattgaccttgggattcagaaaaaaatattccaggtgaggcatgatggctcacacctgtaatcccagcactttgggaggctgacactggaggatctgttgagttcaggagtttaagatcatcctgggcaacatactgagacactgtctttacaaaataattttttaaaaaattacccaggagtggtggcatgtacctgtattaccttgggaagctgaggcaggaagatcccttgaacccaggaggtgaaggctgttgtgagctgtgattgcacactgcactccagcctgagtgacagagtgagaccctgtctcaagggaaaaaaaaaatcaaacaatttttgaagtcagaatagagtagcagtgcgattgtacgtagcctgtatgtgttgcgtgtgcagaatgcaacatatttccatggctacttccgaaatttcaatcatcctcttccagaatttccttctccagttaccaacaaatatttattagggaataaatatgtgctagccactgagatacaaatacagacttatgtactcctctcctagggactgtattctaccatggaactagatcttctgtaagatcgaggcacagatcatcggcaagtctaaaaggaaattaaaagataatttttaaggagttctaattttccttcattgttgatgacttttcacagtattacttccttgttggtatatgagaacaaaatgctggcttgtcacatggttcttagaaagactgtctagtcataagaaacattacttgacttacttaattctctggcagttttataatggcatatacaatttctatacactactttaaaatggagtcaatgtaattttcagcaaagctttggaacagattcagccaatgtttgtcgtaacatagggatgcatgctggaaatggttctctctgcttctgtggctgggtgctcctggagccaatgctatactgcaaaaatgaagcactatgttgatgatatttctttaatcaattattctgccaataaggtgcgttagtttatatgcctaactagcattcttcttctgagcgaggtgcatgaggtacctgagagatcactattattgtgtcattgaatcatagttctattattttcagagaaaattttcatttctcaacggttaaatgtctctacaattcagtatgtctcatgcctagctctctaaagccacagaacttatcaaaactagtcttaatatctgtaaatactgactgttggttaaaagtctaggccctgtggttaaactgcctggaatgaaatcttggcttagatactaactaaatatgtgatcttgagcaacataatttctctctgactgagtttcctaatacacagaaagagaaaagtcacaccagctatatagggtcattgtgaggtttaaatgagatagtacatggacaaaaatgtcttgccaaagtaagcacgtaacggatattagctacagtcctcatcattgtctgtgcccctttttgtcgtgtatcaccatagaaaagaagggaacgactcgacttaaaagttttctggtagttcttatctaaatgatgcaaatagatgaatttttaatacatggatgtggatttgtgatatttttaggcttttgtgtttgcacagataattatggctttttaaagaatcaagttatcagatcatttcattttcagatattaaaaaataatgaaaatggaaaagtacattgaaaatgtgatcattgagggaatatatttagcaataaggagatgacaatgcaaccaggaggggcgaagagagagacagagatataaatgagcaaaactttctttgcttttgcaagatctgttgtttataggataagcccagttgttttgcagtctagcactgatgctttccatgggaagagcacaggctgtgtatgtgcatgtgtgtgtgagttcaagtggttttacattactaatgaaacacagacttttcccaagataatcaactggggattataatttacagcaaagaaggtgtaggtgcagaaacttaatttctgtggctaaaaacagctggaagtaaagatgtcgctgaaaagacattgttggtccctaagctagtattgaccccacatggagagggaatcccacagcattaaataggcgtctgtagacacaaactgccatgaagtgattcatttataaggaaggtactaattttaaataatactcaaatcattgttaatttctgtactatttaatagtattaatcagagtgaactcatctgatacagcaataatcataagaactgttctataagtttcatttcaaattctgcaataatcattgtgtcatcatgttatcacatactgttatgcgcatccatgtgaagcgaccaccacacaggctttgtgtgagcaataaagctttttaatcacctgggtgcaggccaactgactctgaaaaaggagtcagcaaagggagataggggtggggcagttttatagaatttgggtaggtagtagaaaattattacagttaaagggggttgttctcttgtgggcaggggcaggggtcacaaggtgctcctgagattcattgtccaggagaaggagtgtcacaaggtaaattgatcagttgaggtgggacacgagcaaatcacaatggtggaatgtcatcagttaagacaggaactggctatttttcacttttgtcgttcttcagttgcttcaggccatctggatgtatacgtgcaggtcacgggatatgatggcttagcttgggctcagaggcctgacacataccaattggagaatgttgccatgaaatgacataaaaacaaagactattaatgactatcctaattatactaggaagtaaatcaaaactcttcatcagttagctaccattcttgttagctgattacagcatgcatgtaaaaaatgtctggtaaaaattatagtatgtaaaactaagatatttagctatgaaaactttctatgttcatcttttattatacagcttacatgatgcttcaaaaaataattataaatgttggcatttttaaaacactttttcacgaatgtatttgaaaagtctcttcatatcagaatttaggaggcatacacatatgctgttatatacagttatatatactttactaaaaattgtttccttttgacttgccctctgatgagtaacatttcacaaggttactcgggtaaccttgagtaaattactccatttggctaatccttagtttcttctctatgagtggtgatcaaaatgcctaccctgtcttttgaaagccaaattaagataggggttatcaagcagtgaattgccataaaatgtattatgcatattttatcacatttgtattgttattataaatatgtgtttatatgtatatcctccttagtgaccatgagatcatccagggtaggagctctctggaaatttagaaaacaaaggaaaaaaaaaattgaggaagtggaaaatacaaaggaattttctcagtggtgtttgttctataagctctaaacagtaggccaccaacgtccttgagaatctttcatttatctgtctgtacctcataattatatctgtcactctcgttttattatcagaagatttgcacagttcattttaaagtctaacttgtcctttgtgctgactgccacgcatgtctgatgaaatataacaaattgaacagaggtgccattattaaagcaatctgataaaaagctgcagttgtgaggtacactgaagaatatatttggtttcttcagggaatcaaaagcatttcacatttaagttattttctggaaacttttatgtgaatatactacattttatcatgcagaaatactgtgtatcttttctttcttttgtaaaagagagcaaacaggatggatatatcaatgagttactactaaggtttcagtttttctcatatgacagaccccctgtaggaagaggaatggtgtttccatcaaaatttgattatttttatattaatatttttattaatttttttcaaatttatatatatctatttaaatcttaagataattttgcaaatagccacacacacaatttttctaaatttgatgagtcttccatttcacataattacaggaaattttctcttcatgtgattcctatctgcaagaattccatttactggaatcgatttaaataataccagtcttccaacaacagttcaatttcaatccacagcgtactaaccataattgcataaattacaaactttgctgctaggccttcagtccacaattcactacataaagaggagacatacgtcatgatcagtaaccaatcatgacacttctttcaaagtctccagtgattggtcactgcacatgtataatttgtataattcagtttatgcagagacagggacttcattcccctgtgttctgaccagttggagctcccaaaatgcctgtggctacagtttgctcacagtggtcacaagtctattgaaacatgaatcttattaataggtttttgtttctccagattaaagtcacaattaccaaagatttaaataaatgttttgtatatgtgaaaactctttaatggcctcatttgcaagttgttttatgcgtatgatagctagaatctgctctcgaccagtagaaggtagtagcatttgccagaaattttgtaatggttcacagacaattctatgcaaacaaggtaatatttcctatgtttttatgtataaattatttaggaaaggggaaaatacatcatgataatttttgaaagaaaaaagcctttaaaatttttctgtttctctttttctaatttctaatacagtttattttgagtgaaaaggaggaaagggaacttaatttgtgaagcaactgtttcattttgtcagtcctctgggctaaaaatatatagaatgattggaaagaacatgaaaaactgtcatctggaacagttcctaaagtgaatgtgcagtcacacctttactattctctgattatgctgtgattctggaaaataaacaaggtgtgcatttctcattgaaatatgtcttggaatcttctccaaattaatacctgcatgttatatgatgcatatccatatgtgtacctatagctgtttatgtgcaaatgataactactttaaccaaacaatttccgccattttcttaatatttccattgggtaatcaccttctttaggaaaatgctgagtcataatgataaatataaagccactaatttggatctgtttcttttctctaagcaatatgttcaatgagaaaaacatgtaaagatgctcctcgatttacaatggagtcacaactcaataaacccattgtatgttgaaagcaatgtaagttgaaaatgcgtttaatacctagcatgcatcacagcttagccaagcttactgtaaacattctcagaacacttacattagtctacagttgagcaaaattatctaacacaagttctattatataataaagcattgagtagctcaggtaattcattgaacactgtactaaaagtaaaacgcagagttgtatgggcactcaaagtatgattctactcaatactcatttgcttttgcaccatcataaagctgaaaatttgtaaggcaaataatcgtaagtcagggagggtttgtagtttcctttttaacaaaatggcagaggattctttatgtgtttccaatgtttctttactgaatgttagagccaggttcgtaattctacccatactaccaaccccgaaactctcctcccccttttgcattcactctcatctcaaatctctatgtcttgcaatggtcaagttggcatgaattaaattgtttaacctgtaaattcaacagtgttcagagatgtataaaatgggcaaattcagtgactactttgaacaatggaaacatggcttttcaatggtaacgtcttggattggattcaaatcaggcccctaaaaatttaaggtcctaaaacccattacgaatgttctgagacatccaatgatgcacaagggtccttctagaactgctagctttaaaatgtgtaaaattggtcagagatgacagtctaactagcaaaaaaggaatgtgtctttcaggttcctggaaataatgggcacatttatgtttttcatctctagttactgtcatctctgcagtcttacgtagtcttctacatttccttttgtcttgtaaaaatgcttttctgttagagtttatgctttcatacaataaacatttacatagagacctgtcacagtggtgagcatgtaaaatgcatttaggaaatgccgtttgatgttgtatttgaattgacattttccctacataaaaacctttaaaacttataccagtaaaggccaactttttaaaaggtagtctccttttatgcatactaagagttatcctgttggaaactgcataagcatctaatcagtgcttgctaattgtgggtgctttcagccagagcatgaaattgggcacacaattagcaaactgaagaaatgtttaattgcaagtgcaattttaacctattgtcaagagggaaaatagaaaggatgaaaatgaccattttgattgtggttaacaaagaattaaaatagataaagagtttggacccttgaggagcaaatctcagttccaatatttatttgtctaactttggacaatcccttgatcactgtaagcatcagtttttgttgttttttcatgtgtaaatggggatcataatgttttaattgcaaagtttctgtagctatctgagatagaagcttgaaaccacctaacatggtgtaaattatgtatgtgatagccactcaggaagtgattgctattatgactattattttgaatattaatactactgatgctacaataaagcaaaccaaaatgtcatccattttttccctgcagttcgtcagccaccatggtatgaaactgccatgaaatacactatccattatgctcttaagtattccttaccttgaactatagtatacggtaaaagggcactggacttgagatgaaggaagtgagttttaattctgattgtgtcatttacttgagtaatcttgaagaaatcacttgatatctctgaaattcaggcttgttagctataaaatggagacgatacctacttcaaaagatccaagagagaatagtaacaaagatagcattgtgcttgacatattagctgtgtaataatcttccattaagtttaataaaatggctctgcatatagtgagtgcttctagaaatttatgctaagaattaagtttattttcactttcatgtattttcttatgctgatgttatgaattagatgtcttattttttgacattatgtaccaaaaaaaaatctgcaagcagaaacaaataatttattcaatcaaaattttataactccattaactttgtttcttcttactctctatatgtgttttgaggttttttctttgattttcttattgtacatgtgttgttattattgaaaatttttgagacattaatagtaaaataagctaggctccaggatacttagaatagggaaaaatattataagatataagtttaattcttattctgccagaatattataccttgacaagtaatctcccctccctgggttctgtttcctcatctattaaattgcaatgttactgacattagtatttttatcagtgccaaatgaaatactgagcaacaaagtatattttaagattgaaaagcagtgtaattattgatttttattttaagttctggggtacatgtacaggatgtgcaggtttgttgcgtatgtaaacgtgtgccatggtggtttgtagcacctatcaacccaacacctaggtattaagcatagcatgcattagctatttttcctaatgctctccctccccatgaccccatcccccgaccagccccagtgtgtgttgttcccctccctgtgcccatgcgttttcattgttcagctcctaattttaagtgagaacaaaaaagcagtgtaattattttaaaattccagattaaaaaaaatcatttcacataaagtatgaatatttgcttcctggttttatgaagctaaaaataatatttttgttcagagaaaaatcatacattgtttaagaatataattggaaaataagaaaggtaagtgatgaactgagagaagcaaggaatataattaaaactcagcatctagagagctaaggaagagagctgctgttgtaaagaatagacaaagggctaaatagaaaataatttggggttatgtgtaaacaatacttttcattttgtgaaaggtgtaagttccatttatagatttacacttttccacgtggatatccacttgttccagcatcatttgttgaaaagactactttttccattgacttgcctttgctcctttgtcaaagaactattgattatatttgtgtgggtctatttctggactgtctattctgttacattgatgtatttgcctattctttcaatgatgctacccagtcttgatcactatggcctaatataaggtcttgaaattgggtagggtaggtcctctttctcatccttcagtattgtttggccatgctgggtcttttgcctttccagataaactttagaatcagtgtgtcaatatttacaaaataatttactggaattttcgttgagattgcattcagtctatagattaatttgggaagaattcaggttttaacaatattgagtctttctattcatgatcatatctttacatttattcaaatcatctttgatttaatgtagttaacattttgcaacttttctcatgtagatcttatacatattttgtcggccttatatctaagtgtttgataatttttgtgctaatgtgaatgattttatatttttaattttaaattctgagtgttcattgctggtatataggaaaacaacttttgcacattaaccttgaatcctacaacattactataattagttaattgttcctggaacttctttgttgattctttggaattttctacataggtaatcatgacatttgcatactaaggtagttttaattctttctccccagcctgtataaattgatttccttttctaattgcataagctagtactttcatgacaatgttgaataggagtggtgagaccagacacccttgtcttgttctctctcttagggggaaagcatccagtttcacactgtttgctatgatattaactacaaaaactacgtttttgtagatatctattatcaagtagaagttgttcccctttatgcctaatttgttcagagtttttatgagaaatgtgtgttggattttgtcaaatgccttttcagcattatagatatgattgtatgatatttcttccttagcctattgtgataaattacattgatttttaaattacattgatttttaaattaattaattattttttttgagacagggtctcactctgtcacccaggctggaatgcagtggcatggccacagctcactgcagcctctacctccctggctcaggtgattctcccacctcagcctcccatgcagaactataggcccacactaccatgcccaactatttgtttttgattgtttttcatattttttttgtagagaaggggtttcctcgtgttgcctagtctggtcttgaactcatgagctcaagcaattcacctgcctcagcctcccaaagtgctaagattacaggcgtgaaccattatgccaggccaattaatgtttaatttacaaataagcatatatttagcatgtacaacatgatgttttaaatatgcatattttgttgaatggctaaatagctaattaacatatatattacctcacatggttatttatcaggttttgaatttgaaccaaccattgtatctggaataaagcccacttagtcatggtgtataattctttttatacattggatttgatttgctaaaattgtcttgaagatttttgcatttatgttcatgagagatattagtaattttcatttcttaacagatcttagtctggatgtggtgttggagtattgctggcctcctagaatgagttaggaagtattccctgtgtttatattttctgtaaaagtttgaaaaaaattgacttaaattcttccttgggagtttggtagattcaccagtggaaacatctgggactgatgctttctcttttgaaaagtaactaattgtcaattaaatttattaaacctattcaggttatttatttctccctgtgtgcaatttttatattgcgccttctgtggaatcagtccgtttcatctaggttatcaaatctgtaagcatgaaattgtttaaaatgcttacgcctaatttcttaatgtctatgaagtcaatgttaattactctttttcatttctgatcttagtgatttgtatgttttctctgttttctggttagcttggttagaggattaacaattttattgaacttttcaaagaacactagcttttggtttcattgatttactctactaatttcctgttttcaatttcatttctttctgccctaatttgtattatagatttgcttctgcttacttcagatttattttgctgttatttttctcactttctaaagcagaaacttttatttattttagatctttcttttctaatacatgcattcagtgctacaaatttctctctcatcactggttttgtcgcatcccacacattttgaaaagttgtattttaattttcacttcaaactatttttattttttcttcagacttcttctttgactcatgtaatccttaaaatttattgtattctgcaaatattttggaattttcagcttctttttatttttgactttgactttaatttcattctggtgtaacagtatactttaaataacttcaatagtttaaattcattaagctgtgttttgtgacctagaatgtggtatatcctggtgaatgtgccaggtaggcttaagaagaatatatattttgtgttgtcagatggtgtaattaaaaccagttaattgttggtgctgttctgattaactatgtcttatttggtgtgtgttgactctgtcaattgctaatagaggggtatcatagtcttcaaccataatagtgggtttacttatttccctttgcagttatatcagtttttatctcatgtattttgacactccattaggcacagacacaataaggattattctgtttcatcagagagttaatacctttttaaatttatttatttatttatttattttgagacagggtcttgctctgttgcccaggctggagtgctgtggcgcaatcttggctcactgcaacctctgtctcctgggctcaaacaattctccctgctcagcctcctgagtagctggaactacaggcatgtgccaccacaccgggttaatttttgtgttttttgctagagacagggcttcatcatgttggccaggctggtctcaaactcttgacctcaagtgatcttcccttctcagcctcccaaagtgcggggatcataggcgtgagccaccacgcttggcccttattttaaatgcctcataattttccttactcacaagtctgctttgtctgaaatttatatatttactctagatgtttttggttaatgttagcattgctgtatctttctccatcccttcatcttaatttatatgtgtctttatatttaaagtgaatttcttgtagccaacccatagtaggttcttgtttttaatccaccgtgataagctcttttgattggtatattcagatcattcacatttaaagtgattaatgatatatttatattaatgcctaccataatttataactgctttctagccattgtccttgtttttgtttttacattttgttttgttttacatactttcctgccttcttcagtttgaagtgcgcatttgatattttctactttctcttatctcttttttacttctattttacctgtttttagagattaccttagcgtttgcaatatacatttgcaatatacatttgcaataatccaagtccactttcaaataactctaccttacttcacaggcgtcacaggtacattaacgtattcccaattccccctatgtcatcacatgtaacattgctcattcatttctcatttatctgtaagctagaaccatccaaaatattgctgctattattaattagaacaaattttatgttgtatcctctaagaaccaaaaaaaattattttaccttcatttattttttcttaaatactctttctttatgtagatccaattttctaatctgagtcatttttttctctgagtaatttcttttaatattttttaaaagggaggcttgctaccgaaaatattacttcaagtttcatttttctgagaaagtcattatttcccttcaaagaatttcacttgatacagagttctaggctgtacttttatttgtttttatttaaatatttaaaattttataccactctcttcttgcttacatgattctatacagtgttggcttcctccaccccttcttggcttctttgaagattttcttcttgtttgattttctgcagttggaatattatgccaggaaggagatttttaactgtttatcagagagtttggcactctctgagtttcctagaactgtgatttgttgtctgtctttgaattcgaaaaagcatcagcattatttcttgggctcttccttctgttcctttctctctctctttctctctctcctccatatattatttgcgttatgcacattacacatttcgtaacactcatacatgtgtagaatgtgctcttccatatttttcatttttttactctttacattgtaatttagaaagttcctattgacatatcttcaaacacattatttccttgactgtgtccagcctactaatgaacccatccaaagcagtctttatttttatcttttttttctttctttctagcacttcctttcaattctttcttggagttctcatctctatgcctgcattacctatgtattctttcatgttgtttgtttttatcatttgaggttttaatatactcatgatagttattttaaattcccagttcaataattgcaaagtttctgctgtatctaagtaggttatgatgtttgttttgtctctttaatctgtgttctctgactttaacttgccttgtaaaatatgatgcatgagggaaaataaaacacatagtgccttagcctgaggttttatgttagtctgcccaggatttaagctgtgtctactatttgctgtagctatatgtgacagagactaaaatgtttttgtctcccctgttgttattgggttgccacagagaacttatcttaaataagatctgagacatgaaggcttttcacttgtattccctcattattatgcaggagttctgctgatgtggtgatagggtgtgagggaggataggcattctacagtctcataattaggtctcagtgttttagtgagcctgggcccctgggttgtgaccatcacaagggtttctcggctttttatccacttatgtgatacaagaaggctagagggagctggggttaggtatttctcttctttaagattaattcagctctggtaaaacctcagtccattgggctgtagtaaactagttttctttgagggtaggcctttgttaagaacaggatttctaggctgggcatgttgacccatgcctgtaatcccagcactttgggaggccgaggtgggaggatcatctgaaatcaggaattcgagaccagcctggccaacacagcgaaaccccgtctctactaaaaatacaaaaattagctgggtgtgatgatacatattcataatttcagcgactcggaaggctgaggcacaagaatctcttgaacctgggaagcggaggctgcagtgagcagagattgtgccactacactccagcctcagtgacagagtgagactttgtctcaagaaaaaagaaaaagaaggaaatattcagggggtatttcacaatctgggctttcccctttccctgataaaagaacaaggggatttttctcccacctttaactgaagaacttggtagacctcttggatgtaaaatgaataagagtgtagccccttccaagactggacctcaaagggttttcatccctcaaactagtcaacacccggtgtccagtcattagtcaattatcccttcagttttctggttgttggatctagtgttgacttcttttggtgtgctgtgactcattctgtgtgttcacctgtccttctggttttcaaagggggcagtggtttgccctgtgatcctgattatctgaaggatctaagaaaaattactaattttcagtttagtcagcatttttcttattgtgaggaccagagtgatgatttctaaactctttaaaagtcagataagactaatcttgttttttaaattaaaaaaataagtatgtagtaactagataacttcagtaatctgaaagtctgaccttcaggaagctcaattatacctaaaggcattgtacatgtatgtttataaaaactacctgtgacaatgaaaaagtaggctctaggcagtgaaaatatactgtgtgggggcattcaaaggaagttatatcagaataagaaatcaaaaatatttgcatctttgtattattttactatgtatttgattatgccagtatgtttctagagaagagaagagaaacaataaaatcccagtcattgtttatttcaaaatgtccttagttagctctgcgtgcaggcaggccaccataaatgtgcatccacaaatccaagtccacggtccagggggagtttcctgtaacacaatgcaaaactgagatataatccatcaaatactgcagactcaatatatatttgcaagccaacaaaggataagaatcccaaggtcctctgagtaaaagttgaaagagcacataaaattatgctagccttaggaaagaaattggagaacaggacaaatgtttaggttctatttaatattatttgcctgaataatatggagtcaaggctctgaaaaaaaaaagtagatcaaacaaggatgatttttccaagtgattttatcaccattttttcctttagtagaaaaaataaataaaaccaactgcttatctgttggcgggaaagatatttttcagttaaacaattgcacaaggccgatgttctgctggcctgcttcagtaaggctctaaacattattaaaatatttcttttcagcttgttggtaaagccactgcccttagacctccagatgcccctcatcatgaaacccttcccgagagtcttagagcacctggcctttgtgcaacacggtggatagtatttgcagtagcagaggtccagcagaatcctattagcatgtttgttctgggccaatgcccatactctactggttgctaaatatttggaatagcatcctttaaatcatgaacaaagcaaactatgatgtctggttgtattttaaaaatatatattcttccagtctttcaaaattactttttgatgtaacttatagacaggggtattatttagagtttaatacttgatagaggagatatcatcaataatttcaatcctacaggcatttaaatacaaagttatatcattcaatgtgattgttaaatttttgtatatacacacacacacacacatagaattgtatctgaagaattaatagtatgacatctactttgacatcatccttgaaaatatattatactctgatattgagaaatttgcagattttgaagtaagcccttctcaaaatattcttaccaagaagtctttcagcataaaagagacagtctttcatattcaatcaatacacaatgcaataaacttctgtggacaaaacataggctatgcttgtgattcaattagaaaagtaatatttctgttgaattttgtgtcaaaacaaaaggaagttacaacaatgaggaaggagaggggtgtgcttcgctggagagtgaaataattaattttgaagacatgcagctatattgtactttatttgaaagcaagcaaatgcaaatctttttcttcatcattgtgagaaaagaacagatgtttctatttgacatcaaatattttttcctgaaagcaagtcttagggacagcactaaagttggtatccatttaatcctacatctatgtacttaactatagctgaagcactgtataaaataggtgaacagaaattagaaaaaattaagtagttttattctattaaacgggtatagaattgtgaaattctttagaaaagcattctatagaaaaaaattaagtattctattaaaagggcagagaattgtgaaattatttagaaaagcgttctatagaaaaaattaagtatttttattctattaaaagggcagagaattgtgaaatactttagaaaagcattctatctagaaatgtttttaaatactctgagtcagagctgtctaatcgaacattttgtgatggtggaaatggtctgtgcctgcattgttgagtacagttgccattagccacatgtggccagtgaggactagaaatgtggccaatgtaagatataacctgattttttaaatttcattcatttttaattatcttaaattgaggtttcagtagccatgtgtgcctaatatactttattagatggcacagcccaaaatatttaaacttcaattatctggaaactcatttaggtggaatgtctcaattctgaatgattattaatagtggcataatttctgtatttgtgtttttaatcaaaaattaatgttgtgtgctttcagatgcttgctctaacgacctttaacatgttaaagatcatatataaacaatactgaaaactgcaaaattaagacaagttcatttccaaccaaatcatatatgcattgacaacaatggtagcaaacatcaggaaagctttgttgttgatcttatatgcatattgagagtttctctttttacgtgagacaaatccccaagggatccttaaaaacaaatatttttttcttctcacaaagcaagttatccttccaataaattcttaacccattaaagttacaaaagaaaaagccaagtcagcagatgtatctatgcttgtaaggtattcttgacctattgtgtactcacattcaatcaactagtaggagctttggtaacactattattttcagctctactgacaaatcagtatcctaaactgaaataaaccatgtggtctcagcatggtgaaatagctacaatagccatttctctggaggggtctctatgagggttggtcaagtgtatgtctcatgatatgacttttctatttggtaatgtgtacgaaaaaatgcagaaatcaaactgtggaaaatatttttagagataaataactctgtcatgcttaatgttgaacaaaatcaaacatcagaatattaattagtctccaaactcattttttaagtattttttctagcatttactttatgtcttagtctgtttgggctgctataacaacatatcataaactgggtggcttataaacaacaaacgtgtttctcatggttctggaggccaggaagtccaagatcaaggtttaagcagatctggggcctggtgagggcttgttccctataagaagcaatttcttgccatgttctcatgtggtagaagaggaaaacgagctccctcaggtctcttttataagggcactaatcccattcatgaaggttccgttctcatgacctgatcacctcccaaaggtcccaccttttaataacatcacattggggattaggcttcaacctgtgcattctgcaggggacacaaacttttgaaccatagcacttcattcctgaaatttgttccatttgtctttccatttctctctcccttctttgttccaagtcttctttattttaatttttttctctgacaaactcctttcatctgtgctttctcttatttcctcttcaaatattttaagtgggagacttttataggtcatatgtctactttgattgttacctgtgttgtatttttaaatagactctgaacaaattaatataaaaaatgcagctctaagagaaaagaacaaaatgtcaaatagtaaatacattttgtaaattgcaatcatggagagacaaccttttttgcattgacacacatggtcagttttcaagtatgtcattgccactcattgtaaaaattacttaatgatgccacacagcacacagtctccagtatgctacatgcgttataagctcagcctcattgcccagtcccagcaattttactaaattatagtctagtagtgagatacagagaaggagaataagagaaagttttagttagtatgacctggaagccagaacagacaaaatagatactaatttgttacataagtctatagaatttttgcagttagaggcaatcttagaaaccatcattagacagatgaagctaatctaaagatgggccaagtgactcacgcgaagtcaggaaatagttaatggcaaagtttgactacttaaatttcaggtcctgtgtctatgttcccatcacactcttacaaatgatatacacttaaatgtaatctgggccctatgtttgccaataagattagaaaatactcactagcctaatgtgaggtcaattggttaaccaaatagtttaggaaacactagcctcatagaagggtaaatattctccatatcctacataggtcaggttggcttaaaaactgaacacgtgaaaaaattctaattctatattaggatgttaggataaaaatagtctcaaacctcatctagtcatcttcttctattgactatatctgcattgtgggcaagacccaagcatacctatgggctctaaaaatggtggttagaggacatcacctaaattttctttcctgtcaactttccttgaagagaatatttcttttagctagatggtcagatccctgaaatttctggcacatcaaatgatgacagtgtctctcagctgagagaagcggcctctttgctaaaaggatttgactacctgtttgggaggcacccttgtcccctaggtcatttaatgattttcagatgctcagacaaatatttcccttgctaatgccgtgatgagagcttttggctaaaaagtgtttaggatgagatgttgaccagtgcctcagtatattaacttgcatcatcagtttgaatagggcagactcttagtccttccaggctgtgatcacaaaacccgtaaactgggtggcttataaacaacgaatatgtatttctcacaatcctgataggtgagaagtccaagatcaagatgcaggaagattcagtgtggtaagtatttgtttcctggttcatagatggtaacttttttctgtgttctcgcatggtggggagggcaagacagctctctggggtatcttttaaaaaggcactaatgacactgatgagaagtctctacccttatgacctatcaccccgcaaaatgctccacctcctaatacaatcttcttggtacaacgtattagtctgttctcacgctgctaataaaaatatacctgagactggataatttataacgaaaagaggcttaatggactcacagtccacatggctgggagacctcacaatcatggcggaagacaaaggaagagcaaagagacgtcttacatggtggcaggcaagagagctgtgcaggggaactcctatttataaaaccatcagatctcatgagacttatttaccaccatgaggaaagtatgggggaagctgccctaatgattcaattatctccacctggcctcgcacttgacacatagggattattacaattcaaggtgatatttgggtggggacacagccaagctatatcatatggtatccaactcattcttaggattaggattttaggttaggatttccacgtatgcattttgaagagacacaaacattcaaaccatagcagacagagtttctcaagagataccttatggacatcttgggccaaataactttgttgtggtggatgtcttgtgcattgtaggaagattgcccacatgcgtggactctagatgccagtaacacccctaccagtcatgacaataaaaaatgtctccagacatagccaaatgttccctgagagtcagaatctttctagttgggaaccactgtggtagggaaatggagatgaagtaacctttttctctaccattgtgtttcgtgtgttctcatggattctcattggttctagcgatatttgagcaaactgaacagaaatgggtcccaccctcagcaactttatagcccaatgagacagttaggcattaagaaagtaagtgaatataattctagattgtgataagaaaatgctatgaagaaaaattaaaaaagaaagagattcatggagatcttctcagcctggatagccagggaagagctatctgtcaaagtgttacaatctgaataatgaatgtgatttatctaaatgaatagtataccatgctaataaattattccaagtgaacaggcggccgctgaatgtccaaagtttggatgtttaatactctgcagccataaaaaaggatgagattatatcctttgcagggacatagatggacctggaggccattatccttagcaaactaacacagaaacagaaaaccaaataccgcatgttctcacttataagtgggagctcaatgatgagaacacatggacacataaaggggaacaacacctactgggtcctttcagagagtggacggtgggagcagggagaggatcaggaaaaataactaataggtactaggtttaatacctgggcaatgaaatctgtacaacaatccccatgacacaagtttacctatgtaaaaaacctgcacatgtacccctgaacttaaaagttaaaaaaaaaaaaaaaaagattcaaaggcactggactctactatttgaagtacagacttgcaaaaattctacattagtgcttggcaatagcccagcaaaatgcactttggcagtgaaaattagccacgtcgtaaaatctgcaattcgaatgtatttacattcacaacattcaatcattattctgtactatctattggggcagaggcaacacttttcatgaccattctgggtggccattgctgctttttctatcacagccatttcaagaggctgggacctgaagccccagtgtgtgcctgaagtctttggaagtgtttctaagtcaccacaatactagcacagactcccacttctattcacggccacctcttatgcctggcccagatcctcttcatttgtgatgggcatggggcctcactccattgtcttcagtataaccttcattataatacagtgccttactggaaggaggccttcaatgactacatgttgaacacattatttaacatataaaaatgatctcaacagaatcaataaggtaaccacttgttagaaatttctttctttttgttgggattttttttgtggttctctcttagaaactcttgccacagctcttcttcattcatgattctccaggcctgggctgcactccactgccagagtcaggttgaccctgtgactctgacaccatctccatctctcagaagggccttgctctttaaatttttagttcaacatgacctttgaaatggtcaagctttcctctgtctatttcctattccttatttccttttaagtctgttaataggttccatgttcaactaatggaaactctagaaaagaaagttttaagcattatacatttgtgtcattatcaaaataagaatgtgcatctgtaatccttcaaaggttaactctttggtttcagccataaaatgcaacttgagtcttgataactgatggagaagtatgtagggtaggcatagcacttttttttaatgcatggagtaggaaattcaaagcgacatttttgattatgtatgcatcagcaactgtgatttatggtacctgtttgtgtctgttacatgagtgatgggttcttacgccaaaaataaagttactatattcacacctgaggcctgagaagtaacagttcagtaaaagaagacaagactctataaaaaataccaaagaaataaatacaatgaacacttatagcctgtcttcttacctaagaacttattactttctaccttgtattattaattttgacaactgtgcttctgctcacaaacctgtaaattgctgggctctgcttgcagtgaagctactaccttcattataatacaggaccttaccggaaggaggccttcaatgatacatgtttaacaaattacttagtatatataaatgatctcaacataatcaataaggtaaccacttgttagaaatttctttctttttgttggcatttttttgtggttctctcttaggagacttttgctgaagcttaaatgctttaaaataatttttaaataattaattactacaaataaatgagctatttagcctgaaatattaaagtgctatttccagaacttatatttctgtaattaaaatgccagttttgttctctccgggctctgtttaagaaaaaaaaaaaaagtgattttttttttttttttttttttttttgagatggagtctcactgtgttgccctggctggagtgtggtggcgtgatctcatctcactgcaacctctgcctcctgggttcaagtattctcctgccccagcctcctgagtagctggaactacaagtgtgcaccaccacacatggctaatttttgtattttttgtggttttgccttgttagccaggctggtctcgaactcctgacttcaggtgatccacctgccttggcctcccaaagtgctgggattacaggcgtgaaccactgcgcctggccaaaaaaaagtgattcttaaatgcagatgccttggtcaatttatgtatgtttgagatataaattataattcagaagtatgaaggtgccaagatcactatgggaattaaatatgatattttaagagattttgagaggcttattttctatatatgaatggataaagtcaaccacagttagaaacatcatttatctgggtaacataattgtgatttcatctgtaaagtcaaatacaaggcagcattatgtggattaacatttttttccatattatagaaacagtgttaaggaggaatcttagtcaaattccatttttttaagagacaaaacaaaataaaactgtgattgagagttcaaagtccttaactcactagtagcagaactgggtcgtgtttatgaacttttctcttcactgtactcaccaccatgcattctaaccatgaaagcaattgtagttctacagcaccacaatccatgctagtgctgatacgagaaacctaaaatgaaagggaaatcatatgtaacattgtgttgattgattgaaatgtgtgactagattcagaagtacaagccagaagtttggggaaccttacttctgagaatgggccagttctgactctcagtcaagcctaaagtttgttgctcagttggaaacaaaagcatggatatgattgtccggagaaccctgttgctgaataacaaagaggcataagcagaaaggagaattcagaagcacaacataatctaaatttgatttatggcagtgtgcagtctggatgtctccagcttgtggtttcagcttctacttctcaagtagagaagctggatggtggtaaaatacagcaggctgaggagggccagactggagttgagattttctggactatgaactctgggtgtggggtgtatcttgagaggcatactggccacaaagggcggccggagggaaaaacaagttttgcatgcccatgctctgttcagagtccaagaactaacatctgtttagttttggaaacacaggctggctctgagtatggggatttagaacagcagaaaggtcaacattgtataggagagactcaatgttttcacaatcgattaggagcttagaagaattggggtggcaagactaagaagtgagctgcaaggatctgaatgaaaagggctgtcaggccaaggcccatcagcgaaggcagagaggaactggccagagaccagggcaggaagtgtggctcacaattggaaagcagtgtcagaggagtaagagatgaatgaaacatggattaggattaggattaggagctaacgggtacagaaccaggacacaaacacaaaatctaagaactaccagtcaatcctggaatatgaaaacaaatgtcatggggatcagaattttgtctcaagggaactgtagtgttgctgcttagaagtgcaactgatcccataagtggggaaaatgagacacacacagaaaagtataggacaagaggcctgactgtttcctattctcatcccttcattcttgttgacacagattttgattgaggtttgaagtttaccatcagaaccatatctttcctagaaacagagaaactacccaataagtaaaatcaactacagtatcctccttgtagttttgtcattatttctcattagttttatttcacttatttaagtagcaatgaagggataggcagtagatgacaaagttactactataggagcactctgaggcattatccttcctcaccactaatgcacttctgatttttttcctctgttctcctctcttatttagtcttttacatataatttgggttttacaggcaatgtctcacagagtcagtggccactgtgactgcttcttatcctcattagagcaatcactaatttaaaatcagtcaccatttgaaaacttttaaaattatgtcacaagactgtaggatatttcaagataaggggctagtactcctcactcatatatatccggtcttggcattgggaatcattagccaagttaggagctctccagctggcccattgcaaagcaatgcagacagagggaaagttgaggcacctgcctggttcactgggtttgattgcttactaatccttcacttaacttggaacctccttgctcaacctcttggctcaggtgctggggagaacacaggttggcaagatgcaagttctgccttgcaagcatttttctcctgtatatgcacacacacacacagacacacacacacatatatgtgtgtatatacaggagaaaatgcttgcaaggcagaatttgcacacatatgtatgtatacatacacacacatacacatatattttatatatacatatacatatatattttatatatacatataaatatataatatataatagaaaacataaacatacatatatgtatatattatatgtgtataatatatgtacatatatgtaaaatatatatgtataatatacatatatatccatgagaatgccagaaacaatatatgtataatatatactatgtaatatataatatatactatataggtatatatgttcatatttataatatatatgaacatatttattcactgcttaaatttccactgttaccatgtgcctggaacagcttagacataactatttgcttttgagtagactgaccctagaaacaccatactgtattcaaaacaactagtttctaatcatggaattaagacactaaggtggaaccatttcagactggaagtcattttgaggttcacactgaagctatttcgtatatatctcattatatatacatatcttatgtatacatatatagtatacacatcttatgtatacatatatagtatacacatcttatgtatacatatatagtatacacatcttatgtatacatatatagtatacacatcttatgtatacaatatagtatacacatcttatgtatacaatatagtatacacatcttatgtatacaatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacatatcttatgtatacatatatgtatacatatcttatgtatactatatagtatacatatcttatgtatacaaatatgtatacatatcttatgtatacaaatatgtatacatatcttatgtatacaaatatgtatacatatcttatgtatacaaatatgtatacatatcttatgtatacatatatgtatacatatcttatgtatactatatagtatacatatcttatgtatactatatagtatacatatcttatgtatactatatagtatacatatcttatgtatactatatatataaataaaataaaaaacaggaaattgcttggtgccaaagcacagaagaggaagataataattttgaggtatttgaactggactttgaagaatagaaagtttttttttttccctaaagcagtgaaaacagttgaaaggccagaatgatttatttcaagtgttacctttaaaagaatattaatacttgacagtctcttcacatatatgcctgtttcttttctttcaaaaaaactaaccccatgactagaattttgatctacttttgcctttttttttcttttttagtttaagataaaataaatagtctaacatctgtaacatatcatggctgaatttggttatacacaacatgcttcattttcatatcatatcttacttgagtttaaacctgcttttcatattttactcctttctgttactcaattcaaaagtatttgccatgaatgacttcataaccatacattttagatggtctgcttgggatttttttttgccttatatttttctattggcttattttcctttattttaatatacacacattcccttaatgttgatttcttcacgctgacctgtacccctcccttaaaatttattgccagagatgaaatgcccttgataatcttcaccttaagattcactcccctctctgaattacttcatttggttttcaaaactaaaacttataagaaatctcagactcgcaggaccctaaatataacattagtaatgcaagagagataaaacatataaaagcaggcatactcaaaaagatacagtacaaaatactgaaagaattaacagaatgagaaaaggaagcattaaattcacatcaaagaaagctttgaacattaaagcaaatgaaagtgaggggaagaaatctatatggaagccaaacaatcactgcttcctgacagctgcagttattaattagtgttccatcatttgcactaaatggtcaatcaatacttttgcttctctggaaggccatttgctttgtagcttgcttcttaatgggaaatgattcagcttgtccccttctttgtcattctgtccataactaccagcttggcagagagttcgtaagctgtgctggctctagataagggtaagaattttgtctccagatttcagttctctcctgcccaaccacctcacctgcaatctattgtttatattgttgctatgtatctctattctttctgcatcaaataatgaatagctcattttgtgttgccttcaagtatgacaaattcctttccaaatgtgattccagacagtatatccaaacatgtctttcttttcccattcctgatcatcctacatgtcaagcactgccaacgtttactcaagaaagcttggttagaacccagcctctagaagcagtagattcctactcattcctgactcttttagccacttgtcgtatggcatgagcaggtgtcttaacttctctatttatgtcatcacctcctgtttcctatccacagagctaatacctagctcagagcattattgtaaaaataaaatgaactagcatatgtatataaaaagtaaggtggttacctggggattggaagacacttccatcatatttgttaagtgaatggcatagagcaaataaaaaaaaattgactcattattcttattattcttttatatgattactgctctctcctggagtgcacttctctgcctgactcaccctttaagatacatctcatatagaaactccacatgaaagccttccgtgacgcatgatcatggctattcactcctctattctgtcacagtcctttgtgcatttctcttcatagctctcacacttcatttcaccatactgcacatctgattgctttactagactctgagaatcactgttgctagaacgtatttgttcactgcttacatttccactgttaccatgtgcctggaacagcttagacataactatttgcctttgagtagaccaaccctagaaacaccatactatatttaaaacaactagtttctaatcatggaagtaagacactaaggtggaaccatttcagactgggagtcattttgaggttcacagtgaagctatttcatatctaaacctcaggtgagatgatatttttttgtaaacttagggttaacaaacctatttataattattgtgttaacacaatgcttcatgtactactgatttttcttgaagtgtatacctataggaaatagaaatgtccatggtcataggaacatagaatcagacaaaagttttcgagttaagataactaattggaaatcatatggacataagaattaaataaaaatgggttatttctagagatatatatgtaactaagaaaaaacaaagataaacagatacttgatggcacattactgaatttcaacaatattccttcaaaataagtgacaagagatagtatagtcactgtgatatatggtcctgtccagtgacgttctgggccctaggtctagacccattatttgggttaccagaggttaggcgcttaacctctttctttgctagttttttcatctgcaaaacaggattgaataacactcttacctactcaggtaattcctaccctatgagaagggaaagagataaagcaagtacaagtatttttatactctaaaactctatagaggccgggcgtgatggctcacacctgtaatcccagcactttgggagactgaggcgggcagttcacctgaggtcacgagttcgagagtagcttggccaacatggtgaaaccccgtctctactaaaaatacaaaaattacccggttgtggtggtgggcacctataattcccaactactcaggagactgaggctggagtattgcttgaacccaggagggggacattgcagtgagcagagatcgtgccattgcgctctagcctgagcaacaagagcgaaactccatctcaagaaaacaaacaaacaaaactctatggagtcaaagatactgtgaaatacagcaagtccctgggcctttggtgactctgtatattaacagagggctctcattcaagaccttatctattgtccagcattatttgtctactatgatattcatcttttcaggacctaatccagctggacctctacttttttaatggttctagttttgatttgtatacagtttcagcagcaaactccctacaggccatacactagattcacgtccatttggcactgaggaacaaaagaaaatcaccctacctaaagtgatggggagcaaaatattgcttttgatgaatcactaatatagttttatctagctacagttttgtcaaaaagagactattgttgcaaaccaagttaaatagttttttaaaatattttttattgtagcctaatgaagattacttaattgcctgtttaaaggacttggtggaaaaatatgtgaaccacagctttagaggcccatgagctttgggcagtctatgtcatgttcatctccttatccccattgttggctccaaaactctgttagagtgttcagcaagtgttaaactgctcctaataatgcctaagtcacagtgttggatctcaggtggtgcagacttacctatcccaacttgagagaagaatgagcagccgccataggtcattaacatgccgcctgcatcattcacttacccactaaattgaggtacaaccagatggaaagaacatgggtttttggcacatgggactggatacctgaagtatggaactcattcctaaacaatggctggaagctttgggtagattccctgacctgagaattgtatggcgcattgttaggaaagctaagtctgcaggaaaaaaaaaaaaaaaaaaaggcatgttttggggtcctggctgtgctgtaagcaggacaaattcttaggatttctggtgctaattgagtgaccttatacataccatttcccctcctggggctaaaagaagatcagagaggatcaaagaaatcagtggtttaaaaaaactcaaaacaaaacaacttgagaccctaaaacagtatttggcctttggaggtttttgtttaataagtttaaattgtccccaaagtgtttctaaaaggcaggttgtgctttgctgcaatacaaacacctttgtttctgatgccacacagcaggcttgagagaagcattggtgttgtatttgccctttgtacccatctatgtttgacactcattgaccaaataggttaacattttaggagtctatcattctataaaccacctgagtgacctagaacaagtaactgaatgtctccaagccccagatttctcatttctcccttggagatggccattataatatctgcctacctatgtcagtggttattatgatcaaaggagatcaatatgtgagcatgctttgcaatctttaagcaggaagaaatgttcattagtgaggaaggataaagcttaagcgggagcttggactagataactgctagacaaggtcatacctctattatgcagttacagtatttgataataaaatgtctttaataatcaggaaaattaaaataaatgggggcctcaattatatctagaaagatattcaagaagacagactctcattagaggagaagtctgtggcaagaggcaaacaactccaagattggtttcttaactggttgtgaaattgcctccgtttatcccataagcagacctccccctgagtggatttccttaagagaggttatataggtgaaagatccttatgcctggcagcatattatttagaaatagtccactttaaattgccatggagagaaccaccaaaagatgcagagagctgtttgtgtcacaaatgttaagctataatctcactttcagatttaacctagttttctttgggaggccgaggcgggtggatcacctgaggtcaggagttcaagaccagcctggccaacatggcaaaactctgtctctactaaaaaattaaaaaaaaaaaaaaaaaagccatgtgtggtggtgggtgcctgtaatcccagctgctcaggaggctgaggcatggagaattgcttgaacctgggaggtggaggttgcagtgagccaagatcacgccactgcactccagcttgggcaacagagtgagactctatcataatgttattaaacatgtaaaagaagcatctgacaataatttcaaataagctgcttaattttacaaaggcattccattcctgttttggcactgccattggtcatccatgtgactttgagaaaactactaacacaaataaaaaataacaaatttaacttagttttatttaactcaccttggttttattcattgagtagtgatgatgatggcaagactggggaaatggtagaaacttatattaattgaggtttttttttgtgccagggacgccacacagctctttagcatttcataaagtatcccaatgatcctggaagttgagtaatgcattatccctaccttacagatgattcatccgaggcacatttgtgttagcattttgttcaaagtcacacggatgaccaatggcagtgccaaaacaggaatgggatgcctttataaaattaagcagcttatttgaaattattgtcagatgcttcttttacacctttaataacattatgatggtatgaaaacacattttaggcagcagccaataaacttcaatataataacaattaccatcctgatttgatacagaagcctccaacttcaggtgttcttttaatattctatatgctagtcgattttgtttaccatacgcatagttataaacagtcagtgcacatgttgttgactgacctaaatatttacactgtcacatattattaaaatctcagtgcttttctccaattctgtaagattaattgtctactaaccaatgaaataatttgaatttctacttttcttcttataagcttaggctaatttctatcaaagagaagtttctcaaaaatgaggactggaataaaagcttctgtggcttgttcacagcctcattgactggaagaattgtgtctcttggtgggtaactgtgcatggggtgctaaggactgcttggagtctaagtgggaaaatggcattctgtgactgggaacctctgttccttaaaccttttctgtttaattagaaggaaggatgtcccattttatcctcacttaaagagcaatgaaatgattaaaaatagtgttttaatttcacaacttaggagcaataaataattttgagtctctggctgtcactatcagttatcgctcaacttaatattgttgaagtttagataaggacagatggttctctcttctcagtattagttctgttgcttggcagttaattacctgctactgtgactccctctcccatcaccaagaaatcataaaaacagaaaaagtaacggtatctttctccaagaagtttgctttgtctcatggattggttcctttgacagttttttatttgagagggctcctcttcgtgttcctaatatgccaaagttaagcatgcaacctcggtcttcatgttcacaagttgaaatgggcgtgtgcttcttttacaattatgtccaatacgctaactgaaagtagaacatgcctttctcctaggggttttcaaattcataggatggtttacatttattagcttctgaagtaaggaagatttctcttacaaaaataaatcactctattttttgttaaattgaatctactttgttccccacccaatgttgatgcaataaggagaattttatttgttctatgacttttcaattcttgcacctgatttggaatatcacatcattctgtctgccccttcggtcttgttttatttgaatctttcagcccaacagtcagctttgctgaggctacaaagaaatgcagtgccaccaaaatatgagagaataactaagctggacatttcacaaggctgctgatgtgagaaaatacaattttagcaagttttaatctatgtccctaaacaatcttaagttgaaaatattgagagaagtataacagtaggagacaatgttttgcctaattttttcagacttcaaattagtgaatcgaaatcatgttaaaaatttgcaatttcagttcacaggcagatttctagattttaatatataacagacaaaccacttcagcaattacttttgcttgcactgtggtttttgagaacattggagttttttccatattttccattatctctgagtttttcactgaattttgctatctttacatattctttctaattgaaaagggataatttgttcgtccttgaattcagttttcaaagacatctgaatatttgaaattcacttctctttctccattttttttttgatgttatcctctctgtgttttctttttaaggaaaggtaaccttttgattttgttgtttattttttgaaaactattgtttcaattatgaaacagagataggaaataataatccgataaatgtccaaaactatcattatatagcatgacattcagtaaatacccagtaggagtgctggcttacattgcagaaagacctgcagagacccaaatgttgaagcattgaaagagctgaatacattggactgaatacatagaattcttccctaaaaaacaagggaggcaagtactgtttttttggtttgtttgttttttctcagttttcaccactaatttgcttataaaggaaagaaaatttgagtttctgtggactcttgttttattacattcatacaaaacttttttttttccagttatttcacaagaaagaaggtgtttagttgtccacaaaggactatgcctctggtttggtgcaatttctggttttagtagttcttatccctattgtctactccaaaatgctgtcagcacagtttctccagccccatttatcatcctgtagagtagtacctctttactggctcactttcaaatacctgagtttgctaatgttgcagctttccacgttacaaaagaccctggtagcctccctagagaaggcaattatctattatgcttaggggacacaaaagtagctcacggagggaagtgcctacatactctgctcatgctgaggctgacctaaatcaatttcagatgcctataagtaaaaattgagctctgtatataaggttaaagctgccacatttttattaaagaattatccttctaggataactgcaaatgttgaataattttcatggtgattacaatgttcaaaggaactccaaaataaaaaatagaaatgacacctattttggagtatcttacttccatttccattcactgtctgttacgttttcactctttattatagattgtatgtctgtctttggtttggttctttcagtcttatgatgtgttaataaactattatagactatgtagaggatgtaatcattaaatacagaatacaaacaaaactaatcttttgaaagctattatttagagaaagagctagaacctatgtaaacatatatatattctatatatatactctctatatatattctatatatatactctctatatattctatatatatactttctctatatattctatatatatacagtatatatatagactatatatactgtatatatatagtctatatatatactctatatattatatatactctatatattctatatatatactctatattctatatatatactctatatatatactgtctatatatattctctatatatattctctctatatatcctatatatattctctttatatattctatatatatattctctctatatattccatatatatattctctatatatattctctgtatatattctctatatatattctctatatactctctctatattctctatatactctctatatattctatatatattctatatatattctatatatgtattctatatatattctatatatacattctatatacattctatatatacattctatatacattctatatatacattctatatacattctatatacattctatatatattctatatatacattctatatatattctatatatacattctatatacattttatatacattctatatatattctatatacattctatatatattctatatatacattctatatatattctatatacattctatatatattctatatacattctatatatattctatatacattctatatatatattctatatacattctatatatatattctatatacattctatatatattctatatatattctatatacattctatatatatactatatacattctatatatatattctatatacattctatatatattctaaatacattatatattctatatatatattctatatatagtctacatatatattctatatatagtctacatatatagactatatatagtctatatatgtagactatatatagtctatatatatattctacatttatatgtgtgtgtgtgtgtgtatatatatatatatttttttttttttttttgagatggaacctggctctgtagcccaggctggagtgcagtggcacgacttcagctcactgcaacctccacctcctaggttcaagcaattctcctgtctcagcctctgagaagctgggattacaggtgccggctaccatgcctggctagtttttttgtatttttagtagagacaggttttcaccatgttggccaggctggttttgaactcctgatgtcaggtgatccacctaccttggcctcccaaagtgctgggattacaggtgtgagccagcatgcccagccctcctgtgtaaacatattaaacgataaggtgctcactattttctgagctgtacaacaggaacaattgctgaaaagaatggtacctgaaccctgtattgggtgaccattggccttttgtgtcctgtgatgggtagggcttggcctaggacttccagacactaataccctggggtagaatgcaggcaattagtaattaattgcactgatgtgtctaacatgttgtagtagtggcgattattgctccatttaattcgatgagtaatttagacattaatgcaaagttttagaagtagcagcaatcatttatattatcctttctcaatacattaatagtttaggaattttcattctgtggctggttggtgagatgagatgaggccaatgaaaactccttggcccaggggattggagatttgaaatatttactatgtaagtgacattgttagaaaacactaggcattatgccaaaattacaattatgggttagtgttatggactgaattgcgtccacacacacacaaaatatatatatatatatacacgttggcgaggtgcagtcgctcacgcctgtaatcccagcactttgggaggccgaggcggatggattacgaggtcaggagttcgagaccagcttgtccaacatgatgaaacactatctctactaaaaatacaaaaattagctgggcatagtggtgggcatctctaagcccagctacttgggaggctgaggaaggagaattgcttgaacctgggaggcagagtttgcagtgagccaagattgtgccactgcactccagcctgggtgacataacaagactccatctcaaaaaaattttcttaataaacatatatgttgaagtcctaaaccctactccctgtgaatgtaaggttatttgcagatagggtcctagcagatgtaatcaaggcaagatgggtgttggggtaggcactaatttaagttgactggtgtccttacaagaacagaaaacaccatctggcaatggagatacagtgagaagatggcaatgggaagatagaggcagaggtgggagtgctgcagccacgagacaagaaacaactggggccaccagaagctagaaggggacaggaaggatctgagagctcatggtccagccaacatcttgagttagattttagacttctaaactccacaattctgaaccagtaaacttctactgttctaactcacccgatttgtggtacattactatagcagccctagggaactaaaggagttagaaaccttttcatacttatttagacttactaaaattatacctatcacaaaatattcacaaattggttcaaagaagttgatcagaatgatgatatatatagccaacggttacattcaattaataaactacaaatgagaattattgttactaatgactcacctgggaagaactattaaggtaatttaaagaacacactttatatttagagaaattagctaaatggtcaatgcagttcaatcagtagttttcttatatttactatttcccaggaactgtagcaaaaacaaggatacaaagataaataagagaagacattatgaaagttggttctctatgaaataataaccaggtattttcttttagaattcttgtgtgaaacttcagaattctctataggctattgcattttgttcccaatgctcaggtcttatagtagtgtgcttgccagataaaatatggaggtccccgctgaatttaatttattgaggcttttttgttttgttttgttttgttttgtagtaatatgtcctgtgcactcgttgggacatacttatgctaaaaaagttgttttctggaattcaaacgttactacctgccccacattttcatttgctagatgttgcagcctgggtagtagtgaaagtcatatgcaagatatcaaaggtgagaaactgaagaatcaacacttggaagtggctacattcctacaatctcacttattgccaatttgctatctcaaggggcttataacaattttcagtcatctgtagtacttaagtcttaggaatattttggtgattaaatgaagtagtacattgtaagtgttagaacagttactgttgaatagttagggccctgtaactgttcgtttttatttttttttcccaaatcagtgtaatgcatagtagagcattttcctgtattttgaatgaggatacaagagatggccacatgtgtacatttgctaacaatgtctaatctatttgtcaatactgaaagacacatctttgaaaaaagatgggtcttgttccgtttggttttaatcactttgtaagattccagttcagtgcctgatgagcctctgactttagaagcatgctgttaaatctaaacttttttttttttttttttttttttttttgagacagagtctcgctctgtcgccaggctggagtgcaatggtgagatctctgctcaccgcaacctccgactccgtggttcaagcaattctcctgtctcagcctcctgagtagctgggattacaggcgcaggccaccatgcccagctaatttttgtatttttagtagcgacagcgtttcactgtgttagccagaatggtttcaatctcctgacctcgtgatgcacctgccttggcctcccaaagtggtgggattacaggcgtgagccaccatgcctggcctaaatctaaacttttatgtgtccagtgtattagttcttagggctgctgaaacaaaaccacagattgggtcacttaaaacaacagaaatgtattctctcacagtgtggaggttaaagtctgcaacccagatgttggcagggttgttttttctggaggttctgagtgactctgttcccggcctttctcctggctactggcggttgctgttagtccttcgtggaccttcacttgcaggcttatcactccagtctcggcctccatgctcactcacatggtggtctcctcattgtgtatatctgtgtctcttcttacaaggacactggtcatataggattagggtctgcccgaatccagtattacctcatttagcttcatttcatctacaaagaccctatttccacactaggtttcattcacagatgctgacaactagtaaaacaacctttgcagacattataacagtgagaaaattatggcagtgaaagagatctgatgtaatcaacctccattttgcctttagccttcaaactgcccttaattattcctgggtttgggacaagctaatttggggaaatatttagtttatagttaaatgataatagcccttctcaaccacctttgtaaagctaatgagagaccaccaggtttaaaggatgagaggaacttaaattctgctacggtgtagacataaaggattacccaccattatttcaaaggtcacaagatacacaacttctctaattactcctgcagataacatcactatttgtagaaccaaagattggcctttccagatgtcttttcaggtttttttgcatgcacatctgatgatggatggctccacctggacccactaatcactccagtgaccccaccccgagggactcagcatgcgggaggaacatcttccattcccctgggattgcacccccaaccaattagcaagctcccattgccaggtcaccccctttcttccaccaaattatccttgaaaaaccctagcctctgaatctgggggaagactgatttgagtaataataaaatttctgtctcccgttcagccagctctgcatgaattaagctctttatttcaattcccctgtcttgataaattggctctatttgggcagcagtcaaaatgaacccattggtcagttatactaggctttcaacatactttgggtggacacaataaggaccagtggctatacttcaggggtattttgaaaacctcaacgattacattttatattaataggcatcttttttaacatttaaggtattctctacagtgtatcattggtatagagaaacaaaggttttctttcaaaaagtgttttcctcaatatttctagaacatacatttaggaactatttagggaacaatatctaggtaacaatacatgaatattatatttaaacactttatgatttgattgtaaaacaaatttcacagtctagaattcccaatgctttgagaagtaaataatgggggtaaataaaataaaattggtaagagaactattttttttcttttagcttcccttattttggggccttcatctctgcattccaaattacttcattatttttaaagtgccattcaattttcaattgtataacaagtgtttgctaagcaattacgtaaattttcttgtttaggtgggcaattagatgaactgaatgctaagatattttaagctaatattcttgcatgaaaatctaaattttctcattttccagagaaatgttaataaattttactcagccatgcaattaaataaatgccaacacttagattattactattcttaacaattaacaaatttcacaaatacttccaaaattagagtggtgtaaagagtagtcttggattgtgaatgacctcattttacagtttactaatctataaatgaacattaagtacctaataataatgccattgtcatgtttaaatactttatattagtaaagaagctataacagattttccatagcatatattcaaaatatattatttctcttttcctctccatttttaaaaataaaccacacagtcatgcccattaaatataaccagatatatttacttgcttggttttccttttgttttttcttgtcggggaattatagggataaggaagagattgatttttgcttttttttctgctgaagttataaatgcttgaatttggaattattttgtaattctagttgaaatgtgaaggagcatttactataggaaacatatggtcctataaaccagtatcagcagttttcaggtaatcaataaaataaatacgagatatccccatgataccgctattgtccaataaacgattacctgttacacagtgtcctttgcattgtgtaggataaaatgacagattatgtacaccgattttggtaatttccaggaaacaactgactcacagaagcttaggtggtgtacttggaatataaatgcacatactaatggagctgattttatcattcttaaagcataatcaaagtcagtagtttactaccactgaggagaatgatgctttagatcccagggcacttaccacaggaaggatacagggatgaggccatttgtaagccacatccagaagatggtgagatgacctctgtgttcctcacataagaaatttaacaccagcacttacccacacacactaaaaccaaataatttggatagcctcgttgtgattcacgtacatgtttcccaattgccggcaattttcactgtcaggctgactaaatgcagatcattaacttacagggtcatgtttttcaggccgttttggtattatgtaagaacattctcaaatctataatagcaagctctacccagtaatatttatagaagcgtatgtgtaattgttagtaggagaaatatctgaagacgattttattcgctctgtaaatatgtaggtcagggtcttaagaaaatgctcattgtaaacatttcttttttggacagggagatgtccctgatgttccccctagatgtccattgaagtactactcatgggagattttatttaggccacctagcattttgctgagcattctggttgtcagaaaaagataaagcacctgctgttatgttgttgctcactaagtagagaaggggtccaatggctaaaccgacgatttcaactcacggtggcaaagagcatcacgagcatgctcaggaagcacgctgaggaggcgggcacccaaccgaacctgcagagacggaggacatctttctggggagacaatacctagactgagttgtacaagatgaatacgatttagttgtgtggcgtgatgtttcaggtaaagcgttcatcttgagaaaatgcatagaataataataataataggggtctgaagaagaagataagagtggtatggtctgaccaggtctgtcaagataagtagctgtaatgagggagtggggaggtcacggaaagcttgtatgacttgcaagtgagtttcacccttatcagatatgcaatggagagcccttgatgtttattgcaaataatgcgagccagttttgtcattggcacttactggttttttgcttgtttgttagatatctgtatcttccagaagttactgaagataatggctacaggtgtgtcaattggcttgcttgtggtaatcatttcacaatgtatacctgaatcaaaacatcaggttgtacaccgtaaatctatacaatttaatatacacaatttttaggctgcaaaaaaaaaaaaaacgaaacaacagcctttgtcctaattccattacacattaaaacatgtattaactagtagaaaaaaagcacagtctgttcttcgagttgaataaaatcctcagctttctgtccttttagacaatctaccatgatcttaaatgaaaggcttaagttcaaatgtggcagtgttccagaagtagtactgtgctgcatatcaggtcagaaccaggcagggtgtaggctgtttaccatagaaggggatggcctcttagtgccaggtcgtcgttctcagtggaaatatatttagcatagatcaactggctttggtttcttcttaaactctgttcagaaaaaactctgagaggtggctacttgatattttaaacttgaccacaagtgttgaataccattcatttcaactatgaaaaaccatttccattatgaagtagaaaattaaaccctctggggctgatccacgcggagctcagttgaagtattacactttctcatctcaggaaggtgggcttctgatgagtctttccattgctgactaagccccagcacagcaaacctgttcttcattagggctcctcagacagcaactcaccacctccagggagtagcttaaaacagctgacccatacacatatactgttgagacaaaagtcttttcaattaaaatagaggcatgatcacagtgagttttaaacaggagattcatatgagcagattctgatttttgaaagacgacagtaaaagcagaatggaagtgtcaatttcagaaaggcaagaggatgtacacaggttacctaggaggttactgaagcagtcagtgctaaactatttgtattaagaaaaaaaaagagcttaagagaaatgcacatttatactgttgtgtcaaactccaaaaataaatggaaattgtgttaaacaataactagtatagatgagtaattttaaatatatgtatatatatatttatttgtatttctaccagatgtgtgtattaaatatagatatagatatagatataataaaacacaggctagagtttattaaattactatcccttatgatcacagccctgaggtccattataccagtttggttgttcttatctctttattgtttacatccattttctatgcaaaatgtgaaaggagctacctctctaaaaccctcggaaagattttcaccttgaaaataacaaaaaatggacagcttcttgtaaatctaatcaaagctctaacatgttttgaccagttacatagtttttaaaaggtgagggacagtagagctaatttaaaatgctaacaagtttttaggtaatcaatcttaacaattagatgattaatagctggggagttaatcatccccagtcacaaaagaatggctctgctcctgcttcatacacaattaattgtgagccagcaacgtcttgccattatctactgtgtctgaacagctattgagttgaggtttcctttatcatctgatgatgtataatttgattgtttcccttaaaactcattcctaaccaaaaatcaaaagaaacatactgagactttgatgatgaaaataatatatctaacatttaaaataaatagattttataacttggtgacgaactcagtttgctctctttccctactccaataaaaattattggttctgaaactaattttgacatttaatatcacattaactttcattgtcatttaattgctccatgtcctccttgttttcccatagattttaaacccctaggccttggacatatttctgaattcctcatcccattttataacattgtacacatccaataaatgtccacaatataattgaacagaattgagatcatgacgttttatctcagtaacttgataggcttgtaattatacagtatgccctaaagtgttgaattacataatctctacccccttttattttcttttacctgattcatttcttatttataactaatgtttattaatatgtaaatatgccccatcctttcctcctgaccgcaacatatatatacaaggactgtggtttctgttttatttacatttgtgaccagtttcttgaatgagtggctaaataattcagtgaatagaactcctactatctgtttcattgacttagtgagtttttaattctctcacttagtgaaattttacttgtcatccttgtttttatttccaccacttcccattcctaaggatgccttctattctataccttagttttagatggttaccacattgatgaataataatcaattctttttattttatatgaatgcaacatcagcttccattttcaaaggaaccttctatccacagaacacaaactaggaccgtgctaaaatttcaggagcctagtgtttattgtgttcataaactcatgacattttccagcttgaggtgatttaagaggccatgtagcacaaacttgtattttacagatgagaaaactgagcattgagcaagttaaatgatgtaccaaaagtcaaatcactagtgaatggcaactgagactgaaatcaaagtcccctaggcctggctgtgtccagattgtacgagtgcctcatgatatctaagctacaaaaccatgatgggggatgaggggagagtcttgctagtgtctcacagtgcggctggatgacaagttaggaacaacagcaggactgaggcaccagagttgctaggctatgaaacacatcacgtggaaccatggaatcacgtgcaatattttatttattatttattattttatttttattttaatatttgcttaatatttttatatatttttattttaatatttgcttaactgttttttatttccatcaagttgctcatttcaatgtttaatgaacatttagggaacagagtccaagatctgggttcaaagacctgagcagcagagtgagatgaaatcaagaaacctttcataaatctaaaaaatgatctgtaggctgttgatacaactcacaatatcagattggcagcctggaaattagtatcttcagttgaggaatacattaaaatcttaaactaaggtctttcaagaaacttaaaacagcacggatagaagtgtgtttttaacgtataaaattatttgtgcctgggatttaatttctttaacacattccaaaattcctttagggcataggttttgttctgcacaccactgaaattctgcataaggcacagtgtctagaacccagaaagtattaaataattttttgaaaaaatatactcatgtatatattccttagtttttgtcaatagttatttgatatttagtaaaaattacattttttgtctatatatatatataaaagcatccaaaatgatagagaatagagtgatatctaatgctaactgcccaaattacacaattattcccagcgagtacctatcatatgctgaggaattaatctgtagattcagatacagtacagtggccaagattcaccaatagatttctatttttttcttatacacatttaacatcagaatttgaacatcatagaagtttcaaaacagtttgtagaagctacttaaaatttgtttcagatctcctgtaatatacattttattattttgaccctgcaaagcaaatatcatttttatttataaagccgatgacataaaagcttattatacagaaacttgcatttctcatttcctaaaacttgttttctcttcacatgttatgactttgtttcaacttaccataaattcaccttgctgttccagttaaacttgaaatttatcgtgtactccttgctgctaaccagtaagtcagtgaggaaaatattgtatgtcagatgcttttctcagctctattttcctctcttgttggaattgccttcttcatttttttgtgtgttgtatatgatattctactgcatttttaaagaagagagataacttcaatgcatttataattcaaaggtttactcatgttgttcttctgttccagatgatagattttgaaccattctttaacactgatttggccatcataccaaaaagaaatacagttgtccctcattatccgtgggggaattggttccatgaccccatagataacaagattcaaaatccaaaatcggatgcttcagttctttattttaaatggcatagtattttctataacctgcacacatcttcctgtatactttaaatcatctctagattacttgtaatacctaatacaatgtagatgctgtattgatagttgctatattgtattgctatttgcattattttttattattgtgattttaatggttttgtattttcaaatatgtattttcaatctgcagttggttgaattcccaaggatacagggtgaaagtgtgactgtgtatgtataaaagaaactacattttcaaaagttgatattctaatcataaaaaatagactgcactaatatataatcatagaccactaatagaaaagatattaattgggattgagaatggaaatcctatgctggctaaaaagtctctgatgagctaaatagactgattttgctaagagctactctttcaagagcccacgggaaataggtacttattcagtttagtcaaacattcaggaatccagacccttagtaatttgaaactgtgacagctacaaacttgaccaatgtcaaatttacctatttcccatcaaaataaatatttacataggaaataaatcataaaaacagaatatttggggatgaagcattattcttttcagttgtcattttattcgtttgcttattatttatagtgttttataattaactgcaaaaaacaaaaaacaagaaataaaatatatacatttaaattcattttaaaatttaaattttaaaccatgttttaaaaaatctaactttagattttgaaataactcagactattttgctaatttgtttgaactagtacagtctcatattataataagattaagtgacatttacttagtttgactaccctttcctatagcgaataaactgacatttaaaaagttgctgcttgctggcacttaagattgactgatgaggatgtgcagtcatggaggaagagccaggactgagaaagaaatataaatgaggaaaaggaagagagaaaaggagccagacaagacttgaggagagatgagagaaaggaaatactgtttgagggtagaaataggataaatgaagtcacagagaagaggctttcatttccacatctgttacttgaccatgtccatggtatgagagtttcatagttctttttctgtttttgcaggctgcatgctcaaatattctctataaaacataaacccatctccttaccctctcttcatttagcatttattttcaagatgctggctacattggtacattaatttcttatagatatttaatgagtcagttcacattaactggtgttcccttgcttaaaataataataataaagatgctggtagcttgtacctatgattttggtcaccaaaatacaggatgtttttccattacccagtactaataaaaggtgaggtacagaggtacagtaggtgagacaaattcataggctggcagcagcttagtttttcctatatttgaccccaactggagaaatgtgtattattatttttcaaggctgggtatagagctatatattgttgagctgttttattaatataaatatatagagagttaaaattgttttcaaaaagcatgttaggagttcacctaatgggagtgactgagaagaagaaaatgcacagaatttagtataaagaaatcccaaataataacaataaaaaagcataaagtatatctgaagatttatgttcaacaacctagttcaaaatctataagaaggaatgatgatattatcacacagaaaattatcttatgtgaggttctagaactgactgtaggtgtcacacaaaatttagacaacagagattctgaggaaatcaacatatcctacatcaaggaaatagattaaaatgtggtatggtctaaaggtaagaggtctgaaccaatattttaaactacataatgcaagatatactaatattagattctaaatatttttaaatatttgtgatgttacttgtacttgaacaaatgaattttgaacatgcttcataattctgaaactctgccattacttaatgatgctaaaatatgcataatatcctctcctcaaggaatctcgatgtgttttccaaaattaaaactgtgtccaaactgagttttccaaaatccttaattttgagtaatgctgttatctttcacctctggagtgttcacaaaatctatttttattttctgaaggagtacagcgtgtatatattaaacacagctaaatgaaccgagaaagaaatccagatgtttaaccatgaaatctaaattttgaaagagtcttttgaaaatatgctgaaatgttttcaaaatatcatgatgatcaaaacaaattgttattggaatgaccttcactgtaagcagtattaacaatccggtattatacagaaagcatacatctttttttgaaaaatctttgtaattttaccattcagtgataaatataaattcctgaaaatgccattcttaccagaaaaccagtcaatatggttttacattagagcttttaaaaacttagtttgtggccaggcacggtggctcacgcctgtaatcccggcactttgggaggccgagacgggcagatgacgaggtcaggagatcgagaccatcctggctaacacggtgaaaccctgtctctactaaaaaatacaaaaacaactagccaggcgttgtggcgggggcctgtagtcccagctacttgggaggctgaggcaggagaatggcgtgaacccgggaggcggagcttgcagtgagccgagatagcgccactgcactccagcctgggcaacagagcaagactctgtctcaaaaaaacaccaacaacttggtttgaaacatgtatatataaatgtatatatttaaatatacattgtggctatacacctctaccttctctgtattacttatctatgtttatagctatttatatacatgtatatgtatgtgcatatatatacatatgcatatatatgtgtagagaatagaactgtagttactagcagcttggaagagtagagggtaatagggagagattggttaacagacgtaaaattttagctagagagcgggaataacttctagtgttctatagcacgttagggtgactgtagttaaaaataatttagtctatattttcaaatagctagaagagaggatttcgaacgttcccaacattaagagatgataaatgttccaagtgacagatatgctacttactctgatttgatcattacctattgtataagtgcactgaaatatcactttgtacaccctaaatgtgtacaattattataggtcaattacaagccaaaataaaaaaaccacacaaataactcataagaatacaatataacaattattcatatggcatgtatattgtattagtaatctggaaatggtttatagtatgagggaggatgtggataggttatatgcaaacactgggccgtttgacataagggatttgagcattcctggagtttcatatggagcagggtcctggaactaatcttctgcggataccaaaggataattgtataagaatcttggcagcaaaattgtggcagttcagaactataaaaaaaagtcaaagacaatgggaaaaaaagactcagtcaggtgtccttattctctgcttttgatggggcactgagacattgcctgtgaggatttgaggattgattatttccttgtgctaagtgttttcctgaactatgtgttttacctgaacattgaaaacctaccaccacatctgagggaagaactgttgttatttacctatctttcatgaggcaactgacacaagtagatattaactaacttgactgttagttgctgctactaaagggcagagatgattcagagtgaggcagctgcactccagggttccagctctcaaccgctgtgctgcactgcctcccaggaaatactgaagtgctaagcatggttgcgggtctacggatgatgcattacagtttatggacagaaaaataatcaaatgcttcatctgaagaaataaaggattaagaacaatagaacatagattcttcagaaactggatcatatgagtaaggtcacagaaaagtaaaaaagtaacattgttgagttttctgccttttcaataaattaatgactttaggaaatatctattagagatatataattttaaaatatacacacatatatatatataaacttttattcaggtatgttagagagaaccagtagagggagcttttagccgtaagtttactttctattgtgaaaggaattaatcaaataatgtgtgaagaaaaataaattctaaatatgattattatttacgtgatacttcaaagcatccaaaaaataaattaagaatgttatttttttcagttactttggaactcagttacaagacatatttttatttatagtaacaggcaaaatgtatttattgtgtacaacatgatgttttgatatatatgtacattgtgaaatgactaaatctggctaactattctatgcattacctcacatagttatcttttttgtagtgagaaaacttcacttcaactcagtatttttgaaggacctagtatattattaattatagtcaccatgttatacaatagaactcttgaatttataacttctgttaactgaaattttgtatcctttaatgaatacctcctcattccccaccagaaaccctagcccctggtaaccagcattttatttattttatttctatgggatgaactttcttagattccacatatgaatgagatggaacaggtataacgggttatgcataaagtgccttatgtacaggttatacataacgtaccttattatacgcttataacttatgtgtaacaagtataaggtgagatctcattgggttttaatttgcatttatctgataatcagtgatgatgaacatttttttcatatacctgttggccatttgtatgccttcttttgagaaatgcctattcagatattttgtcttttgtctttctgtgcctgatttattttacttaacataatgtccttcaggttcatccatgttactgcaaatgataacacttcgttcttttttaatgggtgaattgtattctattgtgtgtgtgcgtgcatatagatagatatacaaacacacataccacatttgctttatccattcatcctttgatagatgcttaagctgattcaatatcttagctattgtgaataatgctgcaataaacatgggagtgcagatatgttttcaaaatactgatttcacttcctttggaatatgcctagtagtgggatttctgtatcatatggtaattctattttcaatttgttgaggagcctccatcctgtttttcacaattgtactaatttatattcccacaaatagtgtgcatgggttctttttctccacatcctcaccaatacttacactttctcattttgataatagccattctaacaggtataaggtgatatctcattgggttttaatttgcatttatctgataatagtgatgttcaacattttttttcatatacctgttggctatttctatgctttcttttgagaaatgcctattcagatattttgcccatttttaaatcaggctattttattgttgctgttgacttgtttgagtaccttatgtattttgaatgttaaccttttatcagacatatagtttgcaaatagtgtcttccattcagtagattttctcttcgttttgtttattgttcctttacctctgcagaagcttttatgtttcatgcgttcccatttgtatatttttacttttgctgcctgtgcttttgatgtcatatctaaaaagttttattgccctgaccaatataaaaatgctttcttctatgtatttatctagtagtctcaaagttgtgggtcttagatttaagtatttaatccattttgagttgatttttgtatatggtgtgagatggggatgtaatttcatcatttcacatgtgaatattcaattttccaaacagctatcaggttctgggctcttctttgacggtagacattttattactgatttaatctccttacttgttattggtctgttaagattttctgttttttttttttcataattcactcttggtagatggtgtatatcaaggaattaatccagttaagctaggttatccaattttttggtgtataatttttcataatagtctttgatgatcctttgtatttctgttgcatcagttataacgtctcgtctctttgtttctgacttagtctttctctttctgcctttcttaggctaactaaagatttgttgattttgtttatctttctaaaaaaatcaactcttagttttgttgatcttttctatcacttttctagtctctattttattgatttctgccctggtccttattattttcatctttctactaactttggacttagtttgtttttgtttttcaagtttcttgaggtgcaatgttaggtcatttacttgagatcttcttttttgatataggcatttattgctataaaacttcttagaatggataaagtaattcttagaattgcttttgctctcccaggggttttggtattttgtgtttccattttcactggtctcaagaaattttttaaagttttcatgaacattttttcacagactcattgattgttcagaagcacgttctttaatttccatgcatttgtaaattttctgaagtttcccctgttcaatcaaactattgatttctagttttatattattatagtcataaaagatacttggtatcatttcaaaattctgattttttatgaattgtggcctaccatatgatctattttagagaatgaatatgcatagaataatgcttattctgtagttgttggatggaatgttatttatatgtctgttacatacatttgatctagaatgtagttcaagtgtaagtttctttgttttctgcctgggtgatctgtccattgctgtaaatgggttgtaaatctcctactattgttttattgcagtctatatctctttttaagtatattaatacttggtttgtatatttaggtgctccagttatgggtacatacgtatttacaattgttatatcctcttgctgaattaacccctttattattaaataatgacttatttttacctttttacagtttttgacttggagtccatttaatcttatataaatatagctacttctattctcttttggtttctacttgcatggaatatatttttctatttattcaatttcagtctatgtgtatttttacaggcaaagtgagtttcccatagacataccatttaaatcctgtgatatgaaaatttgcctttttgatgctgtcacataagtttcataagctttttttcagtccttgtcattctttatttttttcttctgactttatattttcaaataacctgtctgtaagttcacaaatattgttttctgcttgttcagtttttcttttgatgctctctattgtattgtttgtctttcattgtatttttcagctccaggatttctgtttttttttttaatttaatccctctaatgaatttctcatttttttacttattattattattgttttattttgttcacttctctgtattttttgaagttctccgagcttctttaaaatggttattttatattattttcaggcacttcatgtattgctatttctgtatgatgtcactggcaccttaaaatatctgtttggtgttgtcatgattctcattgttctgatctttgtacttctatgtcaaagcctgtgcatgggaagtcattgcttattccaatttttatagtcttgctttttctaggaaagccttgtggcaggcatagttctggggcgcatcagactcctgagccagtgttgaccagtgtagcactgccagaatcctgggtcctgctttagctggtacaatgctggggcatgccagaatccctggacagctgtgactggcatgacactgccaaaagcctggaacccactacagcaggctaggtgttgtgtttggctggaagcccacagcctctgagaattgcttgctcctgagggctacccaaagcctgggaccactgatgtcaatatggcagttgtgtaggccagagataaatttcactaagcaagcttaaagtgtgaggctatgtggtctcacctggtgagacctggtgtcctggtgggtctataggctcagtctgctggtactggttcggaatatggagctatgaggggtctgctggtgcagagttttcctgtgagtacccagtgttgtgtccaggaaaaatcctgtgctcacatccctttcattctatctagtggatggcatctctttccatactgtgctgcctggggttgggagaggggtgatgtgggtattgtaaaactgtgattcctaccctttcaatgtgtcttttcttattattgtactacaacgaggcactgtgatctctcacgtggtaaaaagatcctagcccttgtgacgttatttttgtgcatagatagctgttcagattgatgtttctgtgaagggatgcttgctggagagtcctactccactgtctggctcccacaaggcatttttgactgctcatctgttgctgtgctggatattatcatccacaggagaattgcaaagatgggtgcctagacacaacgagcttataattttgctggtaaaattgttagcttattagaaatgtattgtgaatgaaatttatacataatagtgtattggcaataagcttgacaaagaagataagcaaacaggagttagaaagaccagagcacagagaataatagctgttcccgaaaagacaaaggatatgaatttatggtgaagactgtgaagggaattttcgatgggaaaatattatgagcaacatggctgatttaggaatgggcatggagggtgaggaatcatatacatacaaccaaaataaaaggttaatatgaaggatataagacacagatttgaatattgcatgaggccgcaagtgctggcaaggagatgaaagtgatccagatggtagtaggaaataagaatacattctataatgagattgcagcaggaatggagagggtaccgaaggatggagctagaggataattaggaaatataaaaaattggaaggaaaaaaccctaacaagaggcaatagcaataatccaggcatgaagtgattaactttgttagatgtgatgtgctgtttttcaagccatataataaactctccttactgaacaaaacaataattatgtgctttcattctcttgcttctccttttagactgtgttaaaaaaaaaaaaagaaaatttaagctagttttggcagtgttccagtgagccagtttgtggcatttttgtccatctgcctttactttcatggtttactgattgcttattttgcagtcttttgtttattttatttatttcttcataaactaaataaataacatttatctaaagtatcagctggatataatggggatagatgtccagggtaattttccatcatacttaaagtcttctttaggagtacttttcacattccactgccaaccactgaccaccagtatgttcacctttagccttcagaactcacggaagaataggcaagattaatcggatcataaggatcatatagaaaacttataaaaatggtaagggtaaaaaatataaattggggtcttcaatgccagtccagagtgtaataatgaacaactgtaaagtttatgtatgaggtgataattttaagtcaactcttttgagagattagcatggggttgtccttagaacggactgaagagcggaagattagcagcagagagagaaatcagaaggctgtacaataggataagtatgaattgatttcagagggaatgaagaagatttaagtaggtaatgagagaagagtaaaaaatcaatgatttactagatgtaaagactggagaaaaaatgtcaaagatgactgatatacacagtttaaacgattagtactgtaatagatatattcgggaaacgagctagtatttagttgaaaattgtgtgtcatttttaggcacattgatttttggtactcacagttgatataggcatatgtacaaatattttaaagctatttctcatattctcatagattccataaagaagactaaaattctaaaggttgaatagccttcatttttttaaaaaaagtatagaactcattagaaattagatttttttcagaaaaatatttggctaaaaatagtgaaatctttttttttaattttattttagatgtctgcatcgaaaccctgataggtatttcatgctatttcttttctggaatgtgaaatccagtattaagtttgatacatcaatcagtatgctatccactctgacatagtgaaattgattagtaaaaaaacaatgcttgtgttgtagaattaaaatttcctttttcttattattatggagaacacatgtcagagtccataggaggtacaaacaggtattctatgacaagggacttgaaaaggtggtgtgtttgtgtcccttaaagttaaaccatcagtggacctaattagcataagttatagatgccttttttcctgaggttgacaccatggagttatttgtcagggatatttttcatccctggaatttgtctttgaatgcatcttattacaaactagtgattcgaccaaattatggatgtacatcatttgtgtttagctaaatagtcacttattgtgtaaagacattttttggaagctctagagtaattcactcttctatgcactcctgcctatgcagtgacttttttttttttaatgtgtcttaagtacttgcctgaaaatcataaccatgcacagtacaagtgtctgagtaaagttacacaaataatattgtaatatgacaatacacatccctcaattagtagcaccaagaataatgcccttgcagtagacctgacaatttcaaacaccatacaatagggaacagcatccaagacagccaaaccctctgtcatggcagaaacagaaacagcctgggaaatgttacctccatattcacttgtggtagtaatcataactgtttattgcttaaattagagagaaagtccaggaaaaaaatttcttatttagctgagtagttttctcattcaaaaatgcatttaactttaggccaggagtggtggctcatgcctgtaatggctcccagcactttgggaggctgaagcgggcagatcacttgaggtaaggagtttgagaccagccttgccaacatggtgaaactctgtcgctactaaaaaatacaaaaaatagccagatgtggttgcacgtccctgtaatcccagctaattgggaggctgaggcaggagaatcgctggaacctggggggaagaggttgcagtgaacagagatcgcactattgcactccagcctgggtgacaaagtgacactctgtctcaaaaaaaaaaaaaaaaaaaaaaaagcatttagatttaaataacatttaatgagaaaatgaacaacctggttaaatatcaaatgattaaacttacattagatgtatagaagctaccatcaaaattaagccttatttactgggatgatttcaaaggtttctattcttatgctgattattctgtgattatttaaaattggtagaaagatctgattctggctcactcacttctgcttcttccatttaattagcaagtatttgccaagtagttattatataattagcattgtgctagagtctttacgatgccaacatttcaaggagcaaattgcttctctcaatgtctgcattgcttgaaaatggagttgttaagtcaaaactcttaagctgccagtaactttctccctctgtttaatagtttaccaagacctccaatgttggaactatcttgcatgtcacaccaattaaataaaatgggtgaatattttcaaattcagtggtggtaaatgtttctagaggaacacagctgtgtgagtgggtgcaatagaactggatttgatatcaagtggccttctacaagtatgattttccacaaaaaaaacacaaagcttaagttaagccctgttattcctactttctctaccttcagatttgagtgataaagacaatagaataaaatatatcctctaagtagaatatttgcattatgtaagctaaaaagattggctttttaaaacaatcaagtggtgaatattcaactccctaatccaatcctttttctttcagaacaactttggaatttcaagatttcaaggttgtgtgctctagggctttgaaaggcagagtaactgaggataattctttgcaaaccataacaatattaatagaatcatcccatcatggttttagaaaacaacaacaaccaccaccaatccattactaaattttacacccaataacattattaaggaccaaaatggatttaagttttttcactttatttacaaacatctaatgctaggcacccagaattagtcctaattgtgctaggtattgctcctagagctttaaatttattatctcatttgatcctcacgataaccctataagtttggtatcattatcttttattgaagaaaagaagtctaaggcaaaggtaagttaaatgacttgcagaggatcacaaagtcagtgggtgattgaaccaagatataaacaaagacaagatataaacaaaggtatactgactttgccatcttaaaagtctgttaaggcggctgggcgcggtaatcccagcactttgggaggccaaggtgggtgtatcaggaggccaggagatcgagaccatcctggccaacatgatgaaaccccgtctctactaaaaatgcaaaaattagccaagcgtggtggtgcacacctgtaatcccagctactcaggaggctgagacaggagaatcgcttgaccctggaggtggagattgcagtaaactgagattgtgccactgtactccagcctggcgacagagcaagactccatctgaaaaaaaaaaaaaaaaagaggtctgttaagggtaacatttgccattggtagataaggtttcccttcacaaaagaagagaaactatggcatatgtgcagtctatgccttctgccacccactaaatagaaagggtgcatgtatcttggaagagactcgttaatcaaacagatgtgctttcaataatggtgaaatctcttcattaagcactggcagtaagtcattacaatatcttctctagccttttggctgtgatcaagggtagactatcttctcattaggataatggggttcaataaaagagtgttccatcgttctccaaaagggagtagagtggaactttttgttaactataatcatttagtgattcattttatcttttttagatcttgttaattcattgttgcacaaggttaatcctttatccacttaggctatggttttgacaaaatgtgttggtcataaaagttaacttcttaaaagacgttaaagacagtttcaatgaacatcagtaacataatgtgtggaaataagaaaagtattttgtttctatttgcttgcccagagtgatattaattaaagcatgatttatatattttaaatgaaataattgaggacatttttgacatatgttttcattttttgtggcaaacaagatcaggagaaaattataaatatttgagttaaacatgtatttggcagtaatattgtttgtgactaaggtcagtccttagtctcacaagattatattatcatgtaaaagttataacaataatagatccatcaaaaattggaaaatatgaaaatgagtctctccctttgagttttttaatgcaattttaccaatcaaatatgacaatgatgaataattttgcacatttacttttagtatcttccccctatgaaaatgcttgtattataaaattttacctactggtaattacagttaactcacaaacttccatcctgattatgcctacttaccattagatcaaaagcatttgccaatcatatccttttaaataatcatttgaatggttctgatatttcaatgataaaattctgtgatttagttttatgcttatagttggatatttgaattatcccagatgtttttgctattataggtaacctagcaacaaagaagttttttcctattatcttttttccatatttggggatatttctgtagaaaataatccccagaattgaatttattgaatcaaagagtataaagctcttgatacggagtccctgaattcttaaggaatatgtttaatccatctatgtagctctggaaactggcttactacctagtatgctcgttacttacatttttgaatgtgttaaacttttaagaaaacctattaaatgactactttatgtgcatggctatctgataataatcttttgtacttataatagattttcctaatatctaataaattttcacatacattatctgaccttatacctacaaaatacttgcaaggggcacaaggcagacattttgatcatcacttttcagagaaaaaataaaaaaggacctaagagagattaaggatatggcgtagaatttagtcttcttacctggaacagcagtggctccattacatcctatctctgtgtacatgtgctttactacggaaagaatttgaaataagttgattttgttttcttttcagtgaataattgcttttattcttaaggaggaaaaatgtctgtcagaatgattttgtctgttttatagtgaaaaatgcataccactccttaatcatcatcatacaatttttctaaatgttcagtgcaaacatcaatatatgttaaagcattattttatacgtttaaacagaaatgaaaggcaaagatcaaagtaacccattaaactctatttatggtacttaaaacattagttagggcatttttaaatgtactatgtgtgttatgtaagtgtgagctctgaattacaaagtaatttaaacaaatacggattcctaaaaatttctcccaggcaagtccttacatatagatcccctataatggtttaagataattatggactgaatatttcttagttttttaaatttagagcattgattgaacattgatgaaattttttcaactttaaaaatgtattttataatatctatccaatatgattgaatattaaattattcacgggatgaaactgcctgctataggcttaatgaacacaatgtacaaaatatactagttttccgtcttttctcctttttttaaaaatttttatttactttttgaatcaggaaatgatcaacctgatttcagagatgagaatattaaagcccagagagtaaagtagtttgtccagatctatgtggtgttttcttttcttttcttttcttttttttttttttttttttgagaaggcgtcttgctctgtcacccaggctggagtacagtggtcgaatctcagctcactgcaagctctgcttcccgggttcacgccattctcccgcctcagcctccggagtaactgggactacaggcgccagccaccacgcccagctaattttttgtatttttgttagagacggggtttcaccgtgttagccaggatggtctggatctcctgacctcatgatccgccctccttggcctcccaaagtgctgggattacaggcgtgacccaccgcgcccggccccaaatctatatggtttttaaggatctttgctggggattcaaagcctattttgttcacttcaaacctcagctcttctcgctgaacaaaaaggcaattaaaagaatgatgatagacaaagttgaaagttcactagtttataatttttaaaaatcctatgccaccatttttctttcagtagtttagacttaatacgtttttgaagattttaactcaatgtaatggaaaacatttataatatgatggaaacatttttaatgaagcttttcaacaaggagttcttaaaataaataaactttgtggtcaaacagagattaaatggctatctattaagaacactatggaatttctattcaaattgggtagcagactaaatgacttctaagatacaatcagtttgtgatttaattggttcttgaatggatctgcctctggcttgtagtctttatactgtaagcatttatacaacaagtctgcaattcaaccatttgactacaaattgccgtaagtttttggaaagctattaaagctcctctaatttttacaaaactctcttgctaaagttattgtgtagcgagggcataccatgtgtcaggtattatgaaagttttccttccttctttctctttgcaattgctctatctacctatttatctaaaatcacacacatatataacatatacatatatacataggtatacatgtacatggatacatgtatgcgtatgtgtatctttactaaatatgtatctatacatatatgtgtatgtatctatatgtatatgtatatatttgtatctatacatatatgtgtatgtgtatctttactaaacctaacagcagttttctaaagtaaacacttttattacctacactttgctagtgaacgtaaagaaagtgaaacaaattgccaaagattacataactggcaagtggcaaagctaggactcaatctcatggacaagtgacatctaagcctttattcttaactactagattatcttatgataatttaaacttgtgtgtatgttttatctttttgttaatcatcagagtcaatgatattcagcatcttctgcagtacagaccaaggaaaacaaagccaagctgtcttaggcagccaaaaaatgactatccatgcaaattaaatgtcactatgttttacaaatttgtctttactattagacatcaactaaagtagttcagaaaagagatgataaaaccctgaatgagtgaagctatagaggaaaatgtgaatgaaaaattaaaaagaaatactaagtttaaacaaatttaattgtggtagaaatttaaatatagaagatggatttcaggggttgtagtattaccacctcaatatttggaggatctgtttacatgtcttctcctaccactggcagaagagccttggggttagaactttttctgtcccttgttatcttctcagtatctcacctggaccaatgctatggcatgttttcaaagataacctagtagtggtgatgaaaggcacagtttcttcatgtttaaagatgagccatgggtttccttttatattttctcacatagactcccagatctgtgaggtcctggaatgtacaagtggttatcctcataaattagctaacaccagaattcatctagtagcatagagcaaaggattgctctgccaacatctgaacaatcaaatcctggcccaaacaagccaaattatctcaacatcaactcatattcttaccacatcctgatgttcctatgctgatattgcttgatcatacagattccattttgttctcctatttgagagtttgagaatctgcttctcttctctttccacccctacctcaccctcctcccttggaattagagattgaatgatctcggacatcttgataatctctcctctctgctctgtatgctcagctactcgtcttacaatcattaatttttaaaatttaactacatgagtgtgccatttgtttttcccacctccagggaaaagagatgaacttgactcatgattttgatcccatgattcatcctcagcccttgctgttggatgtggcggaacactcactagtcctttaataaagatcagatgctgtgtggatactggtgggcttcttgagcaggttgctattgcctacctagaagcatttgccgaggattttcttttcttttgtcgtcagtgctataatatgccacagtctttaaattgacctcagtagtgtctcattgaacttaatatttagttcatttttctgctgacttttgagaggtggcatggccagaaatgtatatagtgattgtatcttttctctttttgccttatgaaatttacttaactatatggcttactaaatatataactggagaaattaaatagcaaaaattttactactttttccatgaaaagttaagtgtttatgtagtaattaattgcttagtccagcttcctgagatataaaaataatgctgataggcattaacaggcgatatgattcactacttttactcattcattcaattttatattccaaagaacatgttttctaataagaggataattaaatgtttacaagtgttatcttggaagtaaatccaacaataatttataataataaaatggtgtttgggttatacatgtggcactgtctcaaagagtcttaatagcatgggaaaattagttttattgtgcagatatattaataaatttaaagataatcaggataacttttgaacatttacaaatgctcaaattcgagcatacaaatttgagtatacaaatttgagcatacacatttgagcatacaaatttgagcatacaaatttaattaaagtatttttacctttttgccaacctaacatccttacgtgagaatagcatataattacatatcactataaagagcacattgtaagttatttacatattgttagactgttagaatgttacctgctaaattggagtgggaactaaacacacatacacacccactgactgagtctggcacatttctgggtcttcctttccttacaggaattaaagttcttgactaagtgattcctaagtttttcccaagtataacatgggtatacatttatgtttctaattttaaagaggctactaaatcttacattttatcatgctctctaattcctcttttttttatttttaaattttactctaagttctgggatacatgtgcagaatgtgcaggtttgttacacagttatacatgtgccatggtggtttgctgcacccatcaatccgtcatgtaggttttaagccccacatgcgttaggtatttctcctaatgctctccctctccttgcccccaacccccgacaggccttggtgtatgttgttcccctcgctgtgtccttgtgttctcattgttcacctcccacttatgagtgacaacatgcagtgtttggttttcggttcttgtgttagtttgctgagaatgacggcttccagcttcatccatgtctcttcaaaggacatgagctcattcttttttaggcctgcataatattccatggtgtatatgtgccaccttttctttatgcagtctatcgttgatgggcatttctgttggttccaggtctttgttattgtaaatagtgctgcaataaacatacgtgtgcatgtgtctttatggtagaatgatttatcatcctttgggtacgtacccagtaatgggattgctgggtcaaatggtatttctgattctagatccttgaggaattgccacactgtcttccacagtgattgaactaatttacactcccaccaacggtgtaaatgcattcctatttttccacagccttgccagcatctattgttacctgactttttaataattgccattctgactggcatgaggtggcatctcattgtggttttgatttgcatttctctaatgatcagtgatgataagctttttttcctatgtttcttggccgcataaatgtcttattttgagaagtctctgttcatatcctttgcccacttgacggggttgttttttgcttttaatttgtttaagtttcttgtagattctggatattagacctttgtcagatgggtagattgcaaaaattttctcccattctataggttgctgattcactctgatgctagtttcttttgctgtgcagaagctctttagtttaattagatcctatttatcaattttggcttttgttgccattgcttttggtgttacagacataaagtctttgcccatgcctataacctgaatggtaatgtctagattttcttccagagtttttatagtttggggttttacatgaaagtctttaatccatcttgagttaatttttgtatgaggtgtaaggaaggggtccagtttcagttttcagcatatggctagccagttattctagcaccaaattcccaattagccaaaaattggtttaagtgattcataaatctcaagtaaatctggatgttaaaggttgaaccttaataataattacagagtaaatggaaagtgagtgaatctcactggacttgtttctttagagccaagggttgaggcagagttcatagagcctgacttttatggattcaagttgtgcaggattttctgaccaaagcttcatcctgtgatttcatcttggtcagttaaatctaaataaattctactgtcatttactaaaatatttagggcattgttatgcaatctaagattatttacactttaataaatacatgaaaattctaattgtatttattgtgtcaagttttccattgcaaacactgatttatttttttcagtcaaataataactcaggaaaaaaaatagaccaggtgaggtttccttacacattatccatgctaccatttatttaagaaacatattattgatcttttatgtttttgcaaattccatgtaattaaaaaaaaaatgtaagaatggtcaatatctgaacttgcttctgtgttttccatgatgacctatttatgttgcattatagaatttaaccaactgtgtatgaaagtttagatgatattaacatgtgagtcaataagaaaagaactgttatacagaaatattggaatgatttgactttcaatattctatactcaattgtatgcaagttagataaaatcatgttgaattttatctcatgtacgttaccaaagcaatacaaattccttagaagttatataagtaaaaatagatttatttttaaattatcctggaaaacattgtcttggtattcaaaccattttcacctgtgtttatcatcagaggtttccatcttttagaacatttatttaccagttctcttgtatttttctcagctgtctgtttgccatatggtgttactttcagaattctctgtaatactgagaggttgtgcttgtggtaacataggataaaattccatgcagacttgaatatttgaaatcttactatatgaagattcaacctatacgaaaatagaagcttaaccataatttataggtattatgttagaaaaatcccagctatttctacatctattttttattcttttgtggacatgtagatacattcttagcaggcagatctggcctaaggcaagctagtggtatagcaacattggctttcctgctttcaataagacacaagttttattccccctgaagtttaatgcctcatatcttaatattctcttttgattcccttaaggcaaccacccatgaaagttgcattcagactcttcattctcagaaggtatactcaaatgctatttcttccagagacattttaattctagtaggagtcaaactcgtaaagaaaatggttgaaactctgagacaaattgataggtagcatgtatagttaagcctgctataaacagtaaaagaagcaacataaggtagaacattttcccctccaaggagaaaaaatcatgtccgttaagtatattttgattcattttttattgtaatttttgttatccctggaaatagaacaaaaacatgtgtcagctgactaccattgaacctgtacacaccctgcttcagcttttatccaatgagaaataaaattaagtcatgtaggttgttagagtctctctctctctctctctgtctctctctctctctctctctctctttttaactgaacctggctgcaataataatactgaccttgactgtgacctctctgtgtgatagttccattgctgtgccttagagtcgaatggtatctctacagttttttcagaattcttgggtaaaaaatgtagcaggtgttgtcaggggttaggaaagagaggctatttattctttccctgtagttttggatggaaataaatactttttaggtgatctgtttctaagaagtgcagttttccggaaaccacacaccgtattctcaaaactattttcctgtttcttccttagcatttagtctaatcatctcaaagtaaaggattattcttaataaaagaaaatacggctgctcacattaaatttgcttcaagtccaggagaaaacctgcttcaaattttttaaagacatttttgcctccattgtatatggattattagcccaatttataagagtaagtgccagaatacagtctttggtggtattttagggtgatactctcctgcaatgggattgattttagaatttgtagggtatatactagttgaggatgtaattggaatttgtgcctgtaaacctataagctccaatcctaaaagacacatgtttattcattcaaaaatatatatctagcattggtgttgtcggttactttgctgggcataaaaactcagagatgaatcagacacagtagagaatgtctgcaatctataggaaattatattctgaacagggacggactcaaaagtgtatgtgtgaatatatgtgctcttttaaatccaagaaaaatattttccacatcaccaattgtgccactgaaaaataaattgttattggtatacagtggcatttgaagatattagaaaactcaaatcaaaaagggaacattgctctgccatgaataaatgatgtttatacttctctttgcaaactgctatgtcacctccaggataacttgtcaagtgcattttcatattatgtttcaaataacactacccaataagtggaacttagaaaaatgtatcagtgtgcatattcttatgttctgaataataagaaatgtgaaatgtcaagtgatgaactaatagcaaacaaataattcaaacctctctaggttagcttgcaacacagagtcagaaagtgcatcaagaaaatgtaacagtgtgcagaatgaatttgtaaactgatttattgacacattcaaatgatacagtgctatttataggacactgtactatagatgttcctgcagttactggagaagaaactcttgtcctgtggggtctacagtgactgccttgcttcaataacatatgtttatttgccatatcgttgtccattttctaaaatagaatatactttgtaaggattttcaataagtttatgaatatgaaacgaaagtggatgactgaaggaattttctaggcttcattagttgacatgcactctttttgagttaaataatatgatattctagaatctaaattgattttctatgaaaatagaaacaaaaataggaaaaaataatattttgatctactccgttggtttacatgaatgcctgcaaaaaataagtaattttgactacctacaaaattgtatttttgcacataccttatagtgtctcttgttttaactaagatgaatttatgataaaaacatgaaaaaaaatcaagtggttaactctaatttgtttattaagctatgttagtaaaagcaactaatactggcctatgactttccaatttaaaaagaattttgtgtcatttcattgaactctccattagcatagtggtatgcttgataacattatcttctgggcaaaattagttgtactactataagtacccatatcactttcttgcggcattgacatctctagtatagcacttgatagtatatggtaggtatcttttcatatcttttctagactctcaagtctcattaagcaaaagatgtttattatctgcgccagtcacacacttcccaaattcaatatatacacacgggcttcctattggtagtaagactttattaactttgattgagttattgtttcaccaaatcgaaaactgaggttccaagatgttaataaatgtacccaagaatgcatatgaatgagaagtagaccaaaatgcaaaggtaggtcctctaattctaaatatcagttctttctaaaatcttgatcttccaacctttcctgttcttagcgcatttgaaattataggtctacacagtataagaaacattattaaaatgaatacagacatattttaaatagtactaaacatttgtgttataacacgtatatatgtaatttttcagaactgcttcctatatacaggtcacagggcactgcctcgtggttatttctaatccaccccacagttcaataactcagaattgtaaaatgtgatcaaataaagtaatcatgatgccaaattcccttaaggatgcatcatttttaaaagtttcttaatatgaacatttcgagtcagtgatttagacagctttgaatatcaatttttcatgaaaaagaacaaatgcgatgacataagcagacagtgatccacttgtgttatgaaggtagcagtaaatgggtgacaatttcttgaaatccagatatgttcaaatgagcagagttggcagcgtgtcctaggcttttttgacaaaggaatgcagtgtcattatctattactttgatgatttatctacgtcacagtaactgcttcaaacctagaaaaaggtaaaggggcaaaaagaattatttttcattgttctgctatgaatccatatcagcatttaggggtttgttttataatgttccttaaataagtttaatttctttacataagcaagtgataattaagtaagcacttttttgatagtaaggaataagctcacttttaaaattctgttctctcacaaacatttcatgacattatagaatccagaaatgtcagctataaaagagatcccaaggatgatgttcatttctcctgctttacaaatggagaaactgagattccacatgaatatgtcacttgatcaagagagttgacaactaaatggaaattagaacttaagttttctaaattcaggttcagaggccggcttcagtaaaaatataggtgttgggaaaatagtacagtgatttccatgagattgcagccatctcttcattattatggtcatgaatatacatatctcatttatttttcactgctatggctctatttcttatttcaaaatgtaaaaacagcaacttttctcatctcttggtggctatatgaacttcagcaatacagaattcagtggattgggccttctccatttcctatttacttctgattacattgttttctcatgatgcattttgttttcccatctggaattcattctctgggaatctcctctctgagaaagcttcaaaaccaaacagtgtttattttttgtaatgacattgcttgcactttcattctgtaatatctccattcagaaatctttaattgttcccaattcctttctagatgagatcgcaaattctctgcttagctttcaaggatcagcacactttcaatcactttttcttaacacttcccaaaacccacctggcgtattaatcaaactgactttttgtagcctctgattagtttcatttctgtacctttgcttgtttctgttttccttttttcctgcccacaaaagatgtaagatctcctttaaattgtgaaaatctctagattgtagtgcttctcttctcatgcactcctggctgtgtgaacataaaacatggaagaggttatcccaggtgtggtgctcaactgtctgggtgaggctttgatctcctgagttctggtctctgtttgccgctgtattggtgattttcatgctgctgataaagtcataccagagactgggcaatttacagaagtaagaactttaatggactcacagttccacgtggctggggaggctttgcaatcatggcagaaggtgaaaggcacatctcacatggtggcaggcaagagaagagagcttgtgcagggaaactctcctttctaaaaccatcagatcttgtgatagttattatgatcaaaagaataatgcgggaaagacccaccccatgattcaactactttccacagggtccctcccacaacaagtggaaattgtgagagttaaaattcaaaatgagatttgggtggggacacagcgaaatcatatcaccgcctacacctgacttcctttctgattcttctttcctgattagaactttcaggacttgaatctctcctctccttccctttttaagaccagagttaagcttcaacttgcttatttcaaaaacctcctactgagaagcactatcaatttgctacttatcactggtgatgatggcaaaatgatccaatcaattttcttccttcagttccatctaaaatgagtgcacacccacatatatgtgttgaaatgacttactttttgttttcttttggattggtatagtttttttatttttcataaaatctgtctgaaaacaattttatttagaaattaaacattatcaatactatatgtcaaggcaagcaactttctttggaatataatatatcctagaaatcaatgcaacatatttttacgtttagattacccccagatgcccagagcatttctttactggtgaaatacagaattcttggacttgacactgagaggaagtgtcagcagtgatctaaaaagtatttcttcttaaaataagggaaatgtgtgtgcttaaagacagagacattagaaaggggaggatgaacagattatattttttaaaaaatggttaggccgggcacggtggctcacgcctgtaatcccaacactttgggaggccgagatgggcagatcgccaggtcagagatcaagaccatcctggccaacatggtgaaaccccatctctactaaaaatacaaaaaaaattagctaggtgtggtggcacatgcctgtaatcccagctactcaggaggccgaggcaggagaatagcttgaacctgggagtcagaggagctgagatcacgccacagcactccatcctggcaacacagtgagactgtcaaaaaaaaaaaaaaaaaaaaaaaaaaaaaaggtgggtggggtggggtggggtgtgagagcaaggtccctcagaagttataaatggatgggcattagtgcatagctatctttattttccaggttaccccttatggaaaaaggttcgcagttaccataacaccaattaataaagccatatttgctggaaaaatcttattcaacagcaaagtatcacagtaagagaaaggacgtttagtaatttaatatataaaaataaaccttcggtagttttgcctgaaagaaggccagtaagtatcttaaacatcttagggagcttttacaagtgctgtagcccttgctttctgttttctagttaagcaaactttattgctttcaccaatgagttacagaatctatgactggtaattttagtcaaaaacatgagttcaattagatgtgaagatacaatcttggcatatgttcttaaatgagccaaacctcctattttaataaataaggtaaatgagcccaaatccatattttatggccattgctcagtgaatgactacacacactattcagtcacccacataagaaatcagtaatttttgtcattcttcttcctattacttctcacatctggttgaaaaacaaattcagtcaccttctaaaatatctttcaccactttcttctcttgtcattccactgccactgccttcattcacctctgtatcatctccaatttacctttttttttttttttttttttttttttttttttgagacagggtctggctctgttgcccaagctggaatgcagtggcataatctcgactcattacaacatctgcctcctgggttcaagccatcctcccaccttagcctcctaagtagctggcactacaggcacacaccatcacgcctggctaatttttgtattttttgtagagatgggttttcaccatgatgcccaggctggtctcaaactcctgagctcaagctatctgcctgacttgtcctcccaaagtgctgtgattacaggtgtgagccaccacacctggagactactaatttatactggtgtataatagtgtccaagtttctagaacattcgtccaataatggctgtaccacccagatatcaatgttttgtttcttctaaaatatagatataaccatatcatataactacactcaatgaaggagccgtttcagtggtttctcaaggcctacagaatataattcacatttactgcatgacatttactaacctgtgaagtcttgaatcaaagatacctagattcaaacataataggtatccaatacagatttgttgatagaaaaatgagagtatgccaaacagggtcaaatgaataagattattcagtttgccctcggcattcctttttgctcatctgttctgtagattcaatgatcgccaccttccatacatccactgtgcattcattctgacactggtcactgtcccatatgccaagaatacagaagcaaacaacacaacccttacgtccaccctaatagggttaataactcatagtagagtcagatattaaacaagttaatacgcagatgaatgcagaattactaattgtcataattgctggaaggaaggaaggaaggaaggaaggaaggaaggaaggaaggaaggaaggaaaataggaaagtgtgttccctgaaaagagagggaagcagactaaatttagtgtaagtgatggtgaactcagggaagcacttgcctcctgagatttgatgtaggacatgatcatttatccaagagaaaatgtgaagaagagcactttaggcagcgagaacaagtgtgtttgttctgttgttgttgctgtttttaagtttgtttgtttttgtctctttcttgaagatgctatacattcccatatttacactttattgtgatattgactctgttgcctggagtgctcttctctgtcattttatgtgtagtgaaattgttcttatcataccatctttttttttaaatattaaaactgtccttaccccttcaggcagaacttaccttgcctcctccctttgttcactcctttcaattgcgattatcccattgcttatagctaactgggtaatttatttttctctagaagacaagccttctagaaggggatacaacttctttattcaatggtaggtcctccgtgttattgaagacatgaggagaaatgaattcagattactgggagacaaaggggaatatttttcaaatcgccacttcaaaggatagtatgcgactcaaaatctaaatatatttaagaaagatatagttaattaatgccagattaacagaaattaaaataaatgaatattattttaacatagatccttacattgtttaagataaattcatacccaggggactaaatattctccaacttattttccttgttcattagagacaaaaagttgatttggattacttagaattaaaacctgttgtgagagcccttatatagaaattttaatagaatcatgtctagatagaaaataacacagtttacattaaacgtctactttcattacagcatacttggcaaaatatcacattttgtcttgttgtgggcttccattctttgaatgttactgaagcccagttcctaagaatccctggccaggtgtggtggctcacacctgtaatcccagcactttgggaggccgaggcgggaggatgacaaagtcaagagtttgagaccagcctggccaacatggtgaaaccctgtctctactaagaatacaaaaattagccggacgtggtggcacatgactgtaatcccagctacttgggaggctgaggcaggagaattgcttgaacccaggaaacagaggttgcagtgagctgagatcgtgccagtacactccagcctgagtgacagaacaagactccatctagggaaaacaaaaaacaaacaaaaaaagaatccctgtagtagtctgttctcacactgctaacagagacatgcctgtgcctgggtaactcataaagcaaaaagatttaatgggctcacagttccacgtggctggggaggcctcataatcatggtggaaggcagaggaggagcaaagtcatgtcttacatggtggcaggcaaggtagcatgtacaggggaactcccctttataaaacctgcagatttcatgagacttatttactatcataagaacagcacaggaaagacctgcccccatgattcaattacctccaactgggtccctcccatgacatgtgggaattatgggagctacaattcagatgcgatttgggtggggacactgctaaaccatatcaatcccctacaaagcccacaacatgtgggaattatgggagctacaattcagatgcgatttgggttgggacactgctaaaccatatcgatcccctacaaagcccagcaaagttggcttccatcccagtcttctgcagtctctctggccactttccgtcctgtttacctcatgcttctgctccatcctcactggcctcctaggacctctgaacatacccaccttgttcctgctccgagccttttgactggggtttgttgtgctagaattactactccacagatatcagataaccctatggcttgttctctcttttccattaagttctgctaaaaatgataccttatcagtaaggccttctgaaacctctaatttcaaggatgcttatccattcacccatactcctcatcttcctgtcatgccctattttccctataattaacaccatctgaaatactgtgtattttttttattatttactataatatgaaactctaggttgttcactgttgtcccccaactgtaggcactctataaattgtcattgaaggaaatgcatattaactttgcactcagcgtcactgggtagttaatactatttttcaaatgttataaaatcaatatatgttaattgaagaacatttccaagctgtagaaaatagaagaaaatgaaagtcaacaattatctagcaatcagtacagtaccatgattgacattttggtttacatattctttcagtcatttctttacctataaatatctatttcataaaatgaagatcatattataaatactgttttatagactacttttttagcctatcatgccataaacatttgtcaattgattaaggatttttctacagcttcacccttactggctctatagcgctccatttttcactctgtacctcttgattgcatggcctaatctgaagttacttaagccaagtacactgggaaaatgcttacctacagcacttagttatttaaagctaagtgggttaagtagtctaggaaatagacttggttttcagtaagtacattgcttattgctaaatgctaactttcagttaaccagttaatgaaaccagagggtcaaaaattgcaacatttaccagtggaccaataaattacaattcaaatgagcccagcccttaggaagattgtcaatcaaagctttaagagtactcaagttcatttagtcatattgtgattgaccttgacggtcttcagattattggtttattaaaagttctaggtagctcgaccttcttacgagactgtagaatttgagttaaaaaaagaaaagtctactgtcaccactgtgttagagattaaaacctctgcctagctcctgggtggtgattcagtttttgaatactatttccttttgttgcatgaagttataaaattaaaacttcaatttgttttccagattacagctagggtaaaaattgttttttattattttgtgttgtagagtttttttttttcttttaaattagaagatcaagttcgaggagtcaaaagcttaatttaaaaaaaaagcctcacaaatctatttcatttctagtacattacagttcagtagataatttgaaactgattcatctgttataccatctgttggaaatatgctacagctgttaaatgtccagcaaaatttgaactacttctcgaagtaatttgcccttggtacatgcagaccagacaattttttatttgatttacaaccaagatttctccaaacatgaccgattttctagctatactacttttatttcattattatttttaaacatagctattagacaaaccaaaatagaaaatgaaagaaatctgaactaatttttaagattaaaaataatgaatttattcattgccataagctattaaaattgcattgattgtgttcaatatttttcaaaatatatgaagacttcctatggtgtgccctacattctgcatattgggaaagaaaagaagttcccttcctcagaagaggattattggcagagaaatcaacatataaaccaatattgatcataatagattttcaatgatacagaatgaaaatattatattaggaacaccaaagtcttatgttctttttaagactaaaagtagatgtaaaagagctaactgacagtagtcaatagtttcaagtctcaaaaaactcatttgctggagccaagatatttaaaaagtcctaaagtcatgtactgtactgatgagttagacaaaccctctatataattcaggggttccaaattacaagtcattttaagttgttgaagatcagagatgatatttcttatgtgggatacagtgaagtagatctatgtgtaagatcatgggatgaagccatttctcttttgcaatgcagattttaaaatggaaaatacaaaaatacatcttagaagctaaacagatgaagtgaatacatctcaatagtcaaaactaggaagcactttgccttgcttgcttttagatggatttatttcttatcattgtcagtaattcattgattcaacagctctctgcaaggttgtgttatgctgcatgacagattttgaggctctgggaatagagagtggacacatcaggcacctgccttcctctcatggtatttacagtccattcaacaagaaaagtaataaagaaattaaaaacaaaccagataatttcagattgtggtgagtgctgtgaaacaaaacaagacagtgtgatagaatagtaagcaatgtctcaatgaagacagaaattgagttggttaatttagatgaactgatcagaaaaagtgaaggtagtatttgcgtcagaatcagagtggaaaggaaccagctcttttaaacctggtagagagaattttagctggacagcggagaggatggaaaggcctttgagcaagggtgtgcttggtgtgtatgagagagagaggagagtgaatctagagcttagtgacccagagaaggagtgaaataaaatagcgccagagatatcttcagggccagaccatcttgggcccagtggagcttcgattttatactaaataagaggggaagccatcaggaagccttcagggcatggcaaaatctgatgcccagttttaaaaaatccatctggcaactgtgaagaaaatggattgtaaggagataaagatcgaagcaggaaataagtgcccaataaatatttattgaatgaataaatgaaataaagttgatgtcttttgctgaggctattcaatgtaggcatatccattaaattgctgattatatatgggtttctctgagaacatctatttaaaactgcagaaacctctttcagttaaaagatgtgggtctgatttggcacacaaaatattgaaattcctgcaatattattatatagggtaacatttcatgtaaattcttagaatcaaaatgagaggtggtgagaacaatttgacaatttcaatattattaggtctgtgtagcccagtgcaacatatatgattttacctgaagtcactatagaaaccatttgtcccagaaaactagacttcaaaagcacaggccttagaatcaggtacaatttggcctttgtcctgactttaatatcctttagctgtgagatctgaagcctcctcatctataaaatggtaatactacccatctcaatgggttactgtgataactcaatgagatgacccactcaaaatatttacttggctatcacgtaagtgttcaataaatgattgctattactatcaattgattcgttgattgtggtttaatgatctctgccatctgtatattcatcaaggtccaaattggaaggattgagatgggaggtgggaaggctgcctcattcgggctcacccctataacactgggctttgtctcattaaatggaaaatgaaataaaagagtaaattaggtcacctccatctagtaggaaacaagagagatatagtaaaaagaaaaaaggaaggcagatgaatttattgtattcacttagcaattttcgctgtgtgtcagataagttatgtccaatcagttgatttcattccaattccattatctttagctttttcctaaattagcaattgatgacaaactaattgtacttctcttcatggtccttctgtttgataagttcttttgtgaacttatttgtagactctatgagaaaataattaattctcaatgcaattttatgacctgttttagcaatgacctagcactctagtattttctgtgcaaagttagttgcttctgccatgcagagcctaatataaataataaaagatctctaatataaaatgaaatacataaaatgaggctatatttgtatgggaatttctatgatagatcagtaagtgaaaaggtatgttaaagaccagattgtaaatgttttttgtttgtttatttgcgtgcatatctaaatatctgttacgttaaatgttgcatctgtgtatatgtactatgaagagtaataatagcaatgacttctatggattattagggttctttctttaactgtattgtatgaaattctacaggagcaagagaaagatgtatcttattttcaatagcaaagagtagtccagggaagctggagcaagagatacacaaaagcaatgtatgaaccataaaaatgggaggaaaatatggtataagtgaagatatataagctagattgagtagtagtcaatgagttctttgccctaagaaggagcatacatttttatagcatacttctataactctgaatgtttaaccatttattttatgttgttatgatttaaaaatctagaacgactgggtcaaaacaggaaaaggacttttgaaataatggaaaaactaaggaaactgtgggtaagacaggattaaacaagctgccccaatttatgttgctaggaataaaatctaaatattttgactctaaggagcatgctgctacctctgaaagtcacgcctttcaccaaaaagtattaattatacaaagttaagttaaacttgaccctcaactatgtctaaaaattattataaaaattggaagagaatatcatattctgtttcctgtactttccacatattattaaagaaaaatgtgatatgtgaaaattagaaaatgtaaaatataaattaaatttagacaaaatttggcttgcagacatcaggagtaatttaagaagctctggccaaacctcccaacaaacttgccttctgcttcccatcctgccttgttccttatgactaaaactatcttgaattacaagctgaacgaaaagctcttctatggcttcccaagcagcacagcagttcctcaagaggtcttttgtcttcccccgatgtccatttcagggtctggtgtcccaactcagtgctccaggactgcaccttgccttctgctcctgagtgtcccgatgttgtgtgcccccccacatttctgaccatcattagttattgcattaactaatgaccctgaaatggacatcagggggtagataaaagacctcttggaggaactgctgtgctactgatgatggaaaggaatagtcataacacgtgatgcagggtaaatgtgcaggtataggtagagtagctcgaacttcaaaaggcagaagttgaatgtacacgtaagaccacagagtgatgtgttcaactcagaatgtgccttttgccatggaatttttcctaatataaaagtgaggatgttattgctagaatttctgttcagctagcactgtctcattcttgagtcatttgttgtttttagttgttttcctccattaggcttatgttaccaaatgggtcatataaaacatctatttgaagtgttatagtttaaacatatattgttttgtgaaacattttcagacattatatttcagcagagatgcatttgaaaaccatacttttgtgtcaattacgtatattctgaagtcctttaatcttgtaaactcctgccagtatcccttgccaatagccaaacctctcagccgtatcttttaggtaaagggcaacagctatttcatgtctatttgccaataatttcctctgctccagcttgagttagtacaggattcatatagctagtctgccttcatgattgactgaaattgtgtgaaaataaaactcaaggcccatctgcttttctaattttcatccaagattccctggaagggaagtacgctggagaccaaatatttgccattgctgtgtatggctgtagttttggaagacatcccagtatgggaaaacacaatactggattatttcaaatgttagttctctttttctttcgctccttccctcctttactattatataaaaattctaaatttctccagggatttgactgatttcctagtatttaatgtctgcaggagattgagatacatgttttagtacaacaaaaaagcagactttttagaatgcataatgagtgataaccattattacagttggaaataaaaatggatagtatattgtaatagtcagtatggcaatatgtgcttgcatggagtgctgctacaaccatctctgggaaatttcaaattcattgtgggctctttcatgttgcttgaggtgttccctctttctaaaatttcctttctacctatctgtagtctctaatttcttcagattctattcattaattatatggcatctgacactctaatcattaatcattctgattcctaagttccttcatatttgttatactggataagaggtttggaaactcactctgtaaaagctcagatagtaaatagtttagtttcgtgggccatatgatatccattgcaatattctactgctgtgtgaaagccatcagagacaatacataaatgcatgatgtgtaactgtgctccaataaaactttacttacaaaagcaatctgtgggctgggttgggcctgcaggccatagttttctaactcttggtggttaacactattttggggttttcagagcttgagagaaacttaaacttcctcatattacttgtgtatcacctgtaggaaaggggttcattgacatattcagggtcacacgtttatgatggagccaggtctaatgagcaactcaactaacaacaaccctacatttctaatttatttgtggctttttgtatttgattttattctatttagcattgaattttaaaccatttttattactcttttgttgcttcatgtttaattactttttgtggattcatttattactgccacttatggaggaatatgccatatctttgtatgtatgtgtgtgtgtgcatatatacaaatggaatgtagcgaaatggaattatatatatatatgtgtgtgtatacacacacacacacacacacacacacacacacatatacatataatctgcctgaagtagtgaaaacagcaaaatgcagtgtaagatctcaataaataatcgtgattaatgtcctccagggaaaaatatagtaattgttgcattttttagcttataatatgattatagattatgttttaatttggaagaatgtgagattgctggtgctttacattctgataataattttgcagtcacctttaaaaaaaattgcttattggccctgatctttactaagctcaatttaattctaattattgttattctgaataattatataattttttcaaattattactttaatttttaaatttttaaaaattgatttgattttttaaattagtaaaaaatgtaaaatttggtactcagatgatgaattagttacagaagccaatttgtttaatgtaataactctaaactatattatggttttataaatgctacatataaattctaaatttaaattagctattggatcatttaatcagttatcaacttagtttaattacattcaacgcaaccatatctatccattggatattcactcttagaaaatgtgtcatgcattattatcaagtatgagctagcctgattgagcaggtatggactagaaaaatttctcctagcatgatcctgcagatttataacgtggctttcttcctcattttcttcatatttctactcaaatgctacctgatcattttgtcaaaactttccttgagaaggcagcataaaatagcaattctcttcctctccacctcacccccaaactccctgcccactgtttcatatttaatgttccttcttagtattaattaccatagcatactataaatttacattttttcgttggcatgtttcttcccacaaaaacataagctctacaagggcagggcattgttaatttcaccttcagctgcacttcagtgcttggcagttgatgcatatttaaatgaatgaaatgaacatgagtgaatgttagcacatttctaatataacgggaacattagaaggaatgtttactccaattaaaggcaacacttatctcaaaaattataaaaagttataatcaaatgtatcagaaagtaggaaaatcaaggatgtatgtttgtgctcacagctaaacagaagtagatgttttcgattaatatgaaacccattactttagatgatagctttgtgaattgatacttttaaaacaaattttaagttcttttcattcttttacatttaactttctggggaacttatttatacacacatgccatatttcacagaggcacgcagtataactaagaaaaataagcaattttacaaatattatatgaagacggatttgttgattttaatttccaatttgtatacaattgagtggtgagataataaataataattcatttctccagtatcattggggacttaagtgaatttacaagaaaattagtttattctttctgttgctaaaatattttttgcttataaatttgagagagaaacatttttgaatatatagagaaacattttctgttttattaaacagagttctgagcataaacatttgtggggaatttaagaccactactctaaaaattaagtgttgtggcatgttataatatgagatcttgcttccagactctttgaggttcattgggtttagtacattcattcatttatcctacaaatgtttttagagtacgtgccaagtaccattgttcagatcactggagagtaagcattaggccaactaaaacttcatttcagatagagctttctatctagtgggagagaaagacaacaaaacaattaaatgagtaacaacataacatatatgtattatgacagaaaatcaagcaggatgtggatacagagactgatggcaacaaaatgctgggtgaactagcaaaccctgtcctcagtggcaaaggtcacattgagcagagacctgtgacaagagaggatacttggagtagtagttgcaaaggcttacagcaggggtaggattgtttttaaaggaagaggaggggccaggtgcggtggctcacacctttaatcccagcactttgggaggccgaggcgagcagatcacgaggtcaggagatctagaccatcctggctaacatggtgaaaccccgtctctactgaaaatacaaaaaaaaaaaaaaaaaatagctgtacttggtggcacacgcctgtaatcccagctactcaggaggctgaggcaggtgaatcgcttgaacccgggagacagaggttgcagtgagccgagctggcgccactgcactccagcctgggcaacagagtgacactcggtctcaaataaaaataaaaaagaaaaaagaggaaaggggccatggtggctagacaggaatagacaagaacatggggaaagagataagactagtgttgtggccatcataggccactgggtggcggggtagcaggggttgggcaggggtactttgaacagtaggccaagttgagagcaggagccagagagcattttgagtacagcagccacaagttcacttacagtttgaaaagtgtttcttcagctgctgccggcaaaactatagcagagtgagaggggaagcagggagaccacacagtcttttgtaacagtgatctctggaagctgtatgtgccctatctgtagctatggagttgaagtgaggcagtaggatttggaacatcccagtatcagaagacttagccctccatgccatttcccagagacccagagagggacggtagactcagaacagtcctggccacgttaacattagaagcacttaggcgttggcaaaatgagaaagatccatcaaaggaatcagagagcaagcagctaatgagaaaaaagagaaaaaaaaatcttaatgacattataaaagccaagtgcagaaagtgttacaaatagaattgaggtattgcctggtttcagtgcagttgattggttgagcatgatgggaactgattaatttttctgtcagtaataattttcaagttgatggttattctgtctttacttgctgatgtctagttctttctttctttgatttttgagacggagttttgctgttgttgcccaggctggagtgcagtggcacgatcttggctcaccgcaacctctgcctgccaggttcaagcaattctcctgcctcagcctcccgaatacctgggatcacaggcatgcaccaccatgaccggttaatttatcatttttagtagagatggggtttctcctgttggtcaggctggtcttgaactcccgacctcaggtgatcaacccgccttggcctcccaaagtgctgggattacaggcatgagtcaccactcccagcctcttttttctattctagtgagaacatgtaacatgagatctgccttgataagtgtgcaatatcatctagaggtataatatttcacaccagatctccagaacttagtcatctcacataactgaaattttatacgtgttggttagcaactccccatttcttggtcttttggctttggtaggagtcctctttgtctttcctcctccaacattagtaattctagttccctgttcctataatgtataaatacctgaagatttccaggagatgccagataccaaagcttattacaggaacaagctcaattttactcatgattctcagatagcaagactgaggtgaagtcctttggagtaatgtgctttgctatggttttccatttgaatatcagggttatataaacagctcctgtgttatattatatttaggataacagaattgcctaaattcctttgctaaatattgtttcaaagatacataaaagacatatcagattcaatgattttttaaccaacacataccaatcgttatttcgaaatcgttgttgagtgtctctctccctctctgtcttttgttttcagaaaaatgtgatgagccacttgtctctggactcccccatgtggctttcagcagctcctcctccatctctggtagctattctcccggctatgccaagataaacaagagaggaggtaagccaaattttgattcttttatcaataaacatgttaaataagaacatgttatatttatagccatatatatatataatcacacaacagatgttggcagacaccagaaatcactcctgccacttctattaaaagatccatagatgccattaacctctcatgtaatctccacattgaaataacataggaaaacttaggctggaagttagagatagtacgtcaaaaaggaagacattttgaagttgcctgggataataaagtcaaaatggcataaacgtttagagttaaaattcctattaatcagaaaatcatttagaaagatgtaaaaaagaattgactcccaaaatgcgtacggtgtattaaaaaaagcactttgtatttactgtatattaatgtaaaaagttagttcctattgaaaatgcaaatgccccttgtaatttttcctccggtacccagaatgtagctctattataaaatctgtgtaaaaaatcgttagatgtgtgcaactacaatgtgagttcttgaccttaaatcatggtatttgttagtaactggcagtttcaaattttctagcaattcactgagagtaaaagaacataattaaggacagaggcaaaaaactcttttgcttcaaaggaacactggtacaaacatcagtgaatggcaacttaaaaaggaaagaaacaatattatctcagataaatatgaatcaacaaacagagaccatgatgtttaattcagtaaaacaggaatggtggtggttgacaggggcttcggtggagagggagaaaaaattgagatatctgttaaaaggtacaaagttttagttagacaagatgaataagttttggatatctattgtgtagcatggtgactatagttaataatatgttgcatccttgaaaattgctaaagtaacagcttttaagtggcctcaccatttatgaaaaataactgtgttgtgatggatatgttaattatcttgagttaattatttcacaatacatatgtcaaaacaccatgttgtatactataaatatataaattttttgtgactgcaccttaatacagctaaaggaaaataagaaatgtgaaatcataaaacaatctagaatcaaccaattctataaataaaaaaatgaaagggaatgaatataggaggaagtaagaaagggaagaagggagggaaggagaaagggagggagggagagaggaaggaagaaaggaaggaaggaaggaaggaaacaaagatgaaaaaagaaagcaggaggaaacccaaaagaagaacaagaagaagaaaataaagagagggagaaaaaatattgtatcagaaaagaaaggcatatcagatttagaaagaccaaaaaagagaagaaaatagataggaaaaagctagcctagtgtatacagaataatatataaggtattcacagatctatgaagaggtctcagtcagtaaaaagacttggtgaaagagtgatacacaagcaaaggtagaggaacataacaaaaatgcagttttaatgtaatattagtataaattagctcatttttataacctgatattcatcaggctatggacatgagagagttgttgagttactataagttatcaaaaattctgcataaagatgttgaagtaatataaattttaatatatttctctctcataaaagtcattgaaaacaactaaaacaatgaatatagacagaaaaacatgaaacaagggactggccatacccaaatggtaattatgatacagaccttcccattactaggaaatctaggacaaaatatgaaaaagaaataccatataattctaggtcccaagagagtgtactgttccctaaaagaagtgccataatgccgagagacataaagcacctgtgaggaatggaagcagagtcagaaaatgttactttcaaaagttttgagtgaaaatacgactgaagaagatgatttgctcagtaaatttgggcaagtcaggttctgtcatgcaaacagcacttcaggaatacaaatgagacaatctagtcaccaatgagaaaattgaaagtgcacaataaagaaattgtggccacatgactggtgttgagcaaggaacccatttccatataagacctcgactaaacgatgtaggagctatagttgtaggagagagtataaatgttataggcacagaaatgtaaaagtgtcaattatgggaattagagagatgtgggtgttttttcttcctaacctttcagagcagcaggttaccagatgctgaaactttaggtacaaatttattctgcctttggttttttaatgggaattaacatcttttacaagaaaaaatatataggttttttgctctcatttaattctagaaaagttaaattattttttctttgttttaacataatacaagataccactttacaccatttagagctgcttatgtatttatctactcatacagagagagtcaggtatctgatattaagcttccaaagtgttaatatatttcttaacttggacacttggatttgaggagtatctttactttccttatagtagttttgtctgtagtttgtagaatatatatttatatctacctagatgattgacaggtaggtaggtaggtagatagagagaaatagaatgcatttccagaaagacagatgtttcaaaagcaaaaaaactataaaacaaaagttacagtttcttaactgtgtgacccacagttcatctctttttgaccattgatatactggattgtcatacattagggtgaaattatcacgttgggaaagaaagtgttgtctgtcctatagatatagatctacacttcattgtagcccattttatcatttgttatgtggggatgtgcagctacgtactttttggcttctaaagactgctttgcttatcagcgttatgctgtccataatgacatataactcgccctccccaacgctctcatttttgctccctaatttttacggatggtgaggtaactaagctatatcttcaccctttatgctgctctgcccctgcaggtacagcaagaaacatacatgtagggcttcacccttgttggccacgtaaatgtgggtcaagggaactagcatgagaaagaaaggttatatcctctccaaggaaaaacaaaaagaaagtcatacatagttgttacaatacaaaactttttttttttttttaagacagggtcttgctctgttgcctgggctggagtgcagtggcatgatctcagctcactacaagctccacctcctgggttcaagtgattcttctgcctcagccacacaagtagctgggattacaggagagtgcccaccatgcctggctgatttttgcattttttaatagaaatggggttttgccatgttggccaggttggacaacaaaatattttcttccactctaaaatttatatgcaaatgcccttgggagaagagccatgtagggtgaaattcttgaaaacatatatgtggctaatagccagcattgagagaaaagagatttttttttttaagtatagcatgatgttatatatctggaagatataaagaagacagacaattccaagcagaaaaaatatatgaacattatagaatccaggaatgttggagatacattttcttaatttacaagtggcaagagtcatctgatacagacactatataagtatctgaaagtgagaagatcatatactaacagaaaaatatcagaatgtaacctactaattatacaaatgcagaaaagaacaaattcagttgagcattatgttgataaacattggcttcaagttttattatttacttaaatgatattcctaaagtacattttggagagaaagtttataaatacataggaaagcaccatataaatgcatatattcaaatgacagattgtcacatatttatgaaattgaatttagtttatggttctccacaatacaaatccatctgctataatcttgatgtcagggaccagtacatggcaaaagtatggaggaaatgagatgtttaaatgaaaaatccatgcgtaattctgacatgtcttttggagctcattgtttttagtttattggtgctgttgttttcttatcaacaccttattcctgtgatctgtgttctgatttatccccacatttttaatccatcgaaggcttcccagtcttgtgtcattctgagttagtagcacttagatgtgttactctttccaaggttagcacagatacaaaacctttgaaagtttcaaacagcatatcccttaccttacttttaatatagaattttacagattataaactgctttcatctgtgctctaattgtttctcaatcttcataacaacctggttagaaagaatggtcagttagagatgccaatcaattcttctgccaaactttcaaccttgtacttcatatgccttttgtagaaatcagtccttttcttctgccagagagacagccatccaccacgtggtccaggtctctctccactaccacagaggcttagtgagaacacctgatctcaacggttgctattagaatccctctgctttgttacctgacatcgttttgggaacccaggggactactggggaaacgataacaggctatgtgtaaactagagagaagaggagagcaggtgctggggaagaagtgaagacatgaggccagggtacctgcacagagaaggatgaatcaagctctggtttcactcacaggctctttcagacccctgtttccaacttgcttaacctctgactgaacttcagcttgagtctctcagatgtatcattccagttctaatggtcacctccccctgtctgagctcattaaagtaagtttttcttcctagttactaaaggacttttggttttaaagaaaaacacaaacaaaaactagttattatccccgttttacaaattcaaataatacatatagaaaccccaaaatacatcattaggttctaaagtagcatagctagggaacagtggcacagggagagggacacaaatccatatcttctgctggaacccaacactctttatatgtaattacaccagatgaggtaatatcagtgctgcctttttgaattagcccaatgatggtgcctaaaatgagtttgaagatttgagtcaagttcaatttatttatgctgttatagccagagaaacccagtcatgcaatctcagtatttcccaactaatgtagatcctgaataattttctttcttttcaccttcctgccactgatttttacttagtagatatgtctaagaatcttgtttgttgcctcctcaaagatgtttcctcctatgtattttccctgagtaatttctcccattttaagaatgcgtcatcttctctatcacaccagagggcagaaggttgtggtggtgatgttgttttcacattagttttcctctatttccttcagcagggaaaacacattgcacttgcggtcacataattaataatcacttatcaaaggagtatgtgaataacagatgtttggagagactgctagaatagatctcttgaagtttctacgtgtatctcaaagagaaccacagtccttacctttccttaaaagacaccactttatactagaatgatttataatcctttgggtgtgtacccagtaatgggattgctgggtcaaatggtatttctggttctagatccttgaggaattaccacactgtcttccacaatggttcaacgaatttacactcctaccaacagtgtaaaagtgttcctatttctccacatcctcgccagcatctgttgtttcctgactgttttttttttgagacggagtctctctctgttgcccaggctggagtgcagtggtgcgatctcggctcactgcaagctctgcctccgaggttcatgccattctcccccttcagcctcctgagtagctgggactgcaggcgcccgccaccatgcctggctaattttttttttgtatttttagtggagacagggtttcaccatgttagccaggatcgtctcaatctcctgaccttgtgatccacccgcctcggcctcccaaagtcctgggattacaggcgtgagccactgtgcccggccggtttcctgactttttaatgatcaccattctaactggtgtgaaatagaatctcattgtggtttgatttgcatttctctaatgaccagtgatgatgagcttttttttaacatgtttgttggccgcaatccaacccaaatggccaccaatgatggactggataaagaaaatgtgggacatatacaccacggaacactatgcagctatagaaaagaataagttcatgtcctttgcagggacatggatgaagctggaagccatcattctcagcaaactaacacagaaacagaaaaccaacactgcatgttctcacttataaatgggagctgaacaatgagaacacatggacacagggacgggaacataacacaccgtggcctttcatagggtgaagggcaaggagaaggagagcattaggagaaatacctagtgcatgtggggcttaaaacctagatgacagggccgggcgcggtggctcacgcctgtaatcccagcactttgggaggccgaggcaggtggatcacgaggtcaggagatccagaccatcctggctaacgtggtgaaatcccgtctctactaaaaatacagagaattagccgggcgtggtggctggcgcctgtagtcccagctactcgggaggctgagacaggagaatggcctgaacccgggaggcggagcttgcactgagcccagatcgcgccactacactccagcctgggtgacagagcgagactccatctcaaaaaaaaaaaaacaaaaaaaaaacaccctaggtgacaggttgataggtgcagtaagccaccgtggcacatgtgtacctatgtaacaaacctacacattctgcccatgtattccagaacttaaaaaaaaaaaatcactaaagccatagtttccagtttaatttttaaaaattaacataaaaagacacaaaagacaccactgaagttcataattgccacgatgcctttataccacagcttgctcagataatcactgtaggctggtgtcattttccacttcctgttggccaggaggaagttctagtgataagcatgacgccaacctcttccctagctcacacttacatacacatgtccccctccggaaacgcgctgggctgcctcttacaggctcccaggcagttcagcaaacagtaaaaccttattctactcttgagaaatctattattcctgctactcctagaaagaaaatttttccctttttcccactctcaattctcttgtctctgagttgcatttataaaacaccttctttccctctgctttttctttgctctcctctttttgcctttaaatattagaaggatctgtcacaactaattaaatctagaactgcagctgatatactataaactgggaacggaaccacagcgcgtccatgagggcattgtctgtctgtgtggcctagctcctcctgctggtactcttctgctgtctctagtccgtgatgtactcctttgttacacatggcccactcatgaccgcccgaatcagccacagtaggcggtattcttaaccttaattaggaagctttattcttagaatataacatcaaggcttaaattatgaagtagactcaagttcccaattgatgagattctgccctatttttgcagcttccattccaatatttttcctctttccctttgccagcctctaccatgtagtactttttaaaattttctccttttctcactcacaggtaattcattattacttaagtatgaagtaatcggtgaagtgatacctctcaggacgatttgccttataaaagcacatccttgggagcagaaaaattcaaagaactggtttcctaatggggcatttcaggatatttgacattcctattttggctggtcatacttcttcatcttcaattggctctcctggaaacacctgctgattttgtcggctctgaggcagtgctgagcagtaaaaggagagtggcttgtcttcatgcctaactaagttccagtactgagctgaccaaggacaagcatgggattagcaaattatttaaatgtattatatcttggtttcctgatttctatgattactatatctgaaccaggatataataatgataaaggatataatatggaataatttgtcatctgagtcaggaacttttgacagtgaaagagagtatcattaatagttacacaaggataatcctgaaagtatggtccctctacttgtagtttaaaataaaatcagttatactgtttagcagagctaccgtgaaggttaaaagaaacaatttacacaaactatgttgcattgaaatattagtctctttcccataagttactcccagcttctaaaaacaacactatagataccaacattttaaaacgaggattgaattaaatacctttgtcattacaaagacgatgcctccttaaaaatttattgtttaaatttgtgtatttgccaatgtatgtgtgttttcccccattatcatctaagacaaaatattatcataataatttaaaaattagtaaaataacatttttaaaactttcagtatttttggggtgttaagacttacagtgacttaaatattctgcaggacttttcacctcaaactcctttcaatttaagtgaaagagattatgccagtgatttttaagtgttgttttgttcttattatcttaatgttgtttgaatttgatctcttagaatctatatatcttatagaaactaacatgtagttataagcctcatataaaaaattgttctggacattagggcgaataaaaagtatcacctttgttttccttagcccaatatattctatcttttaaatacaacttttcaaagatttcttctgaagacctcacagatttcatatccacctccccaaatgaatgagagtttccatctaactggtattgtgaattttaatgtattcttttttacttaattctcaaagataaaccaaaattttggcttgactgggagttttataaaattaaatgtgtaatacaggaatatgtgtatcattgacacttgttataaatgatagaatgttgaaagcaaactcaccaggcaatgactcatacattttgtttgggcatacctttttaaattttaaaatagtattgttatttttcaaccattacactcaattttaaaatgttggtatttcaacaccttgtttttgttttcttcatagaaatctgtgctaggttttgttgcaatttccatagagcaatgcgtcccaaagtgcatgatgttaatatgtgtggtgaacacacgtatatacatacaagtttccataatcaaatcagactggacagatcttgtgctctgggatcttcttttggagaatcacagatcgtctttatcacagaacatctttaaggccagcagaatacatttccactttgggatttgcttttataaaatttagctaaacattgtgcggatcacgggctttcaatggggtttctttaatgtacttagaaatatagtcgtatctcccatggtttcactactgtgtttctgaaaatactgattataaaagttctttgataataagtctagtgatttttagtttaacagaatgaactagacttaattagagaaaggggaataaagataaaagagtttttcaattttggacttttgagatgaagaattttttagttaattatttttaggaagttactattttcccctttgtgtaccaaattctatatatcttaatatttgctattgagaaaatcatgtactggcttaacatcaatgctatcacattgatccctgctgccgcctttgaaatggctctggaatattaattttctaacactctctttagatcacaacattaatagctgactgtctaaaagagggggaagtttgcgaataattcattattataatatgtttggtaattttagtttaaacacaatactgaaaactatcctatttggtactggccctataaagtttaggacatatgggatgggataaccacatctgaattagcaaatcaatgtatttaaacaaacaaacaaaaatttaagaagatgtgaagaatacatatacctttgtaagattgttgatatggatctagatttttcgttacccataggagacatcttgggccacttcctacttgtgttcaattgccaaaattcctcactcacttctataatgagaaattttgagtggacactctctaggaccctgtcgtcactgaacgcccgttgtgtagccaagaaagatcataattccttggtcttgatcttactgggctcttacagattcttagtggtctggaccacacctccctctgtgcgtagatatcgtttctatgaaatttctggagaatggtcaggatatctaggcaaaaagctttatcaaatatttacacactgaatttttctttctaaaccattcaagaatataggcaaaatgtgtttacgagaataatcatttaatattcctttatccctttgctttttttttttttttcttttaagacaaggtttgtcacccaggctagagtgcagtggcatgatcagggctcgctacagcctccacatccttgtgctcaggtgatcctcccatctcagcctcctgagtagctaagactatagactcgcaccaccatgccctgctaattttttttttaatgtttgtacagacagggttttgccatgtgtgtcaggctggtctcgaactcctgcactcaagtgatctacccaccttggcctcccaaagtgctaggattacaggcatgagccacagagcgcagcctatatgctaactttattcatagagagtctttagtatttttcacatctcaaataaggaggtggagaatttttgtgaatgatttctaccatcagaaatattcattttaaaaataaaattcttcacagcctgaaagcactttcatgctgtacttatgcaggtttgactctcagagaatattttctaaatgtgtgaacaagtacataaaatattatttactgcatatattattctactaattgtaaatttcaaatactcattgcttatatgtaggaatcatttgttaaatcaagagttaatatttgctggtacttttcttgttccaaaaaactatctcacaaattgtttggtcactgtcgtagccaattggaatctagactataatagcagatgagtaacaacaaccaacgcaattatcatcataaataaactagaaatttaaatctcatttttaaaaatgaatattcagagtcattagagaatggccctctcatatcaacattctttcaacacttccaatattgtagaacagagaccatgaggataatgttgagctgataaagcatgcctttcttatctcaagatattatttcacatacatggctttcgacttgtgctggcttttgggtaacagaatacattgtatcggtccttaacactgtatctggctcataagaaatacattctgtaacccagtagaagcagtgtagcctacaagaagaaatgaaggccaggaaagaatagggcaagtccacaagtagccgtttgggaagctcacatcagctggttggtgagtggcattgaacagagttcattcaatagacaagtttaggccataaaaaaactgcacctgtaaaaactatagttcaaacctgaaaattacaattcctctataccaaatgagtgactgtatttttcaatatctactctcctgtgattaaattccatgcttttgtgactatttatccctttttctttattttacttattaagaggcagaccaaattatttccaagacaattgggaggacttaatctaataatgactctgttagcaaccggctcaggtcatacttattaaaatgaacagacccttctcttaatacccttagcaaattagtgactttttcacatttttttctttcagaattaagaaatatagaattgttcttttatatgcatgccttgcaaaagtaattctaaaaaaattgtcactaataagaattcaaagcagtgtagcctttgttagctgccttttctatacaccaagaatgagcaatcaacattgtttactcatcctcttgctttaaaactcagatatatgcttgacgcgaatattgctgacaataaaacatgacatttaagacagtctatttttattgttcttgcctctttaacatcaaaatgtaaacacaaaatgtagaaagatttcttccccaggttttcacccaaaggtcattttattttatttcccttagctattatgattttcttagcaaggtaaggaattcatgttgcttttattttgcttggttttcattctcagcaacttttgcaatgtatttcctttgcatctgtcttctgctttaaaattgatagacaatggtatctgtttgaactgcgggtccttgtctgcaatatgtctgtaaccaccacctcaccagacatccacaaccggaaagactcttctgcctccaggatgaattattttgcattacaaggtttgtgcctgagcatatgtatgaataatgcataattaagcgtgttctataattttctctagccagtgtctggcacatacatatttggatggataacgaattgggttttgttttgttttcaaccctctgcttagaccaccaaataagtcttataaggatctactcttaagatgatgaaaagtattgttgacttccttactcttcctccctgagtgttctagagggtggaagttaaaatcacgtgcttctgaggtgtacaggcttctatggtactgtgtgcggaattggtgggtttttggtctcgctgacttcaagaatgaagctacggacccttgcggtgagggttacagttcttaaagagggtatatccggagtttgttccttcagacgtccagatgtgtctggagtttcttccttctggcgggttcgtggtctcgctgacttcaggaatgaagctgcagacctttgcggtgttacagctcttaaaggctgcacgtctggagttgttccttccttctggtgggttcgtggtctccctggcctcaggagtgaaggtgcagaccttcacggtgagtgttacagctcataaatgccgcacggacacaaagagtgagcagcagcaagatttattgtgaaaagcgaaagaacaaaccttcccccgcgcatgagggtacccgagcaggttgtcactgctggctggggtggcctgcttttcttcccttatctggccccacccacatcctgctgattggtccattttacagagagccgattggtccgttttgacagagtgctgattggtgcatttacagtcctttagctagaaacaaaagttctccaagtccccaccagattagctagacatagagcactgattggtgcatttacaaacctttagctagacacagagtgctgattggtgcgttcacagtcctttagctagacacaaaagttctccaagtccccaccagattagctagacacagagggctgattggtgcttttacaaacctttaactagacggaaaagttctccaggtccccaccctaccgagaagcccagctggcttcacctctcaatggcactggccacgggactttgtggcacctagcccaggcactccagcagcccagagggagcttgtcccccaaacaagcccagcaggcgcgggctggccaccaagccggcgcccacctggaacccgtgtggcctgagagcagagggagcggactcttgcctctgccagccccagagggggacccccacagcacagcagcgggctgaagggctcctggagtgcggccagagtggacgccgaggccgaggaggcaccaagagccaggaagggctgctagcacattgtcatttctcagtactagagtcatagggattgctagagactcttctcgtattatggtaaggtcatatgttctcataggatcatatagaattcccagaggaggatgattaaatttattccaacaagaggctaataaagcagaaatgatgacttctttactgttgaagggctggcagtccacaaaaacaagtgccaagaaggccaaaatagcaaaggatgttaccactgcccccaccacatttatattcccaaaccttccacacacctacattcacattcaaatagtattaaagtataagcacttctcattggtcttcaggtttttttttaattagatagatcagtcttcttaaacagcattaacatgtttaagcttcctgtcctttggtagtgacttaagttgtcaacttccttaaaagtcattactgacggcaaagtatttctttttggtcatttcaagacatccacgtgtttttttgttttgttttgttttgttttgttttttcgtctatctctatctcagaacttataatgaagtattgtattgtagacttatttttctgaccccaagagactgggtgggtgtcacctgaagacatgtcctgtgtatcaagtatccatgaatacttgacatacaggatgatgccaagaacagagctgatattcacaaatgtagaaataaatgcttgtatgtacatattattttatctgatccttacaaaaccctaggaagaaattcagaagttacaaaactcagtttgatgaataagaaaactgagattcaccaagtttagattcttgcctaaggtcacagctaacagaaactggatctgagtatttgaaattaagtcttctgacttcaaaataattcactattctgtcctccacttgtcttccctgactttgtgagaacttttcttttggaaaaatttgaataatatttgagttggttataaagcataactaaagttttcccactggtgttttagaacacaaaaagagacatttctctttcatttctgagaagcgtatattgagtagattttcattcagaatgcctttgtgatttctttgcatgttttttaatctgttttaaataatctgaaagtaaaagaagttattttaaatatttgcatataatgatgtatttgttaaaagcatatctttttttcactatactaaaagcctagccaaaattgaaatcaatttagtctaatttttgaacttgtattatgtggggtggcaggcaaaaaaaaaaaagacaaacctgtactctaaatattatatatgtgggaaccagtaaagatttgaacagaacaatgagaccaacattctctctaccagaaaagaatttaaataagaaaaaactactgatatgcagcaccaatacgctagaatctgacagaagctgtatttttaaagtcactaacactcttaatattcaaaacacacctgggaaaaagcagtaagtcagtacaaagtgaaagaaaatgaataacaggagtaaacctcaaccacaaaatataaagtatgtgaggcctactagatatgccgtaagtggatctacatttagtgtgagatgagaacaatctggcatcaataataacaatatcccattgtatgatcattatcaatcactaaatgctttcttccctttcaaataaaggattcagcattgtgacattttgcctttcattttgttgttgtttagtagaatgaccatacttcctggaaaactagaaactcccaagggaattgattcattcttttctcccaaacttctttctatcaagtattaaataaagtaaagcaaagactcatttgaccaaatctttcaaagttaccattatctaccttctctatagattatttaagacaatcattgatgatggaaaataattttctaaagactgtttccaagaagcacaaaatacttttggtttttaattcaaaatcctgtatttgaatttcaacaattcaaacaagaaattggaaaccaaatattggtattttgtacaccaaactgtgtttgttggtttcattcccaaagaaatagcactaactaggaagagaagtatgagttttaggctttcaaatcgtggccatcaggacttgagaggaaatatgcaggtgccccagttttagggatgtttattggatacgtccaaatgatgcaacttcagcaaaactatcttatcttcgtgatttggtcagtgatttttttttttttttttgtaagacggagtctcgctctgtcgcccaggctggagtgcagtggcgcgatctcagctcactgcaagctccgcctcccgggttcacgccattctcctgcctcagcctccggagtagctgggactacaggctcccgccaccacgcctggctaattttttgtatttttagtagaggcagggtttcaccgtgttagccaggatggtctcaatctcctgaccttgtgatccgcccacctcggcctcccaaagtgctgggattacaggcgtgagccaccacgcctggccgatttggtcagtgatttctatgcaggggcctggagacaggctttgagtacctcagtcttttttttttttaactttaagttctggggtacacgtgtggaatgtgcaggtttgttacacaggtatacatgtgccacggtggtttgctgcacccatcaacccgttatctacaatagatgtttctcctaatgctatccatcccccagcccctaccccctgacaggccccagtgtgtgatgtccccctccctgtgtccgatgttcccctccctgtgtccatgtgttctcattgttcaactcccacttatgggtgacaacacgtggtgtttggttttctgttcctgccttagtttgctgagaatggcggtttccagcttcatccatgtccctgcaaaggacatgaattcatctttttttatggctacatagtattgcatggtgtatatgtgccacattttctttatccagtctatcagtgatgggcatttgggttgattccaagtccttgctattgtgaacagtgccgcaataaacatacatgtgcatgtgtctttatagtagaatgatttataatcctttgggtatcagtcttaatttagcatcttgtggttccaagtgagaagtttaggtagacagacccagagatgccaatcagaactcaacatgctccttgcagcactgggaaagaaaacgcagggtggaggaagcacacagtcagtggttatgacagagataaagaatgctgatgctttgttacagcttcactttcatgtatttgtgagctctttctaacttttccttccactgatatgacatacatttggaaattatcagttctcctcagcaatttatcaatgaaatggcaaggattcactaaggagtgataaacaggcaggatgttttgtcaacagcctgaaatacgttaatcagcttctggaatgccaacaatttaaattcaaatagatttctcactgagcctgagatctaaaaccctgtgatgctgtttctgtttattggattaatgtagattttaggttcctttgtcctcaactcttgggaatcccccctactatttttttctttgtttggatggcttagttggaatagaaaaaagtgtggttgatttcttcagaagtgttatctgtgtgacctcatactcaactgcgggaataacagaaaggcagaaatcgggaaataaaaatcctgttgccgaatgagaattctacatctcactgccgtttggaatggtacagtgattcatatttcaggcacctcaattagacattcattattcataaacacttatgtaactctgagttattcaggctgggagagaacattgcaatctttctttttccttttctttattatatgacatcttatatcaaaaaaaaagaaaaagctaaaaaaaaaacactctgctacatgtaaatctgaactatttattttaggcaaaatggcatgaataaaacaaagctgatctacatttggctttgtcttgtcaaagaagcaatctgaacaaataggctaagatcaattctattagaggtgaaatacggaccaagataccaacattgatcccttcagccatggcccttgcatatagttccaatgtacaataatacaggtcaggacctggaaaggcctaaatgataagactaagtgtcaaaatcagtgttgaaaggctgctcaaactacagaaaatgaggtatccaggcatttaataagcatgcattgagctaagcacataccaccactaaagattcatttgcatgtgggattaaaacatctgaaaagttgacaagggaacgttttagagactctgagatggtgacatcattatgacacaaggcactgttggtctgaagcacactggtgagtgtccccaaccataaatttggagatagttcaggtggcatctgagtattaatcaaaagaaaatagatacttgtcttactcgatgaaaataataattattttttttgaaggggcatcaataatttaacaaatatttgtggtttactttgtgttcagaacatgttgtagtctatgtcagcactgtctggtaaaatacatggtgagccatatatgtaattttcaattatctaatacctgcatggaaaaaaactaaaaagaaacaggtgaaatacattttatatgttttagttaaactaaaatattgaaatattgtcattttgttatgtaatcaatataaaaattatcaatttgctactttacatttttcatactaaatttttaaaatctggtgtgtatgttacacttatcttgattcagaaactaaatttccatcagaaatacttcatctatatttaaatttcacaacatttatggtttaaacactggactcacatagccaaattgctcccaaaatatctaaaatgttctcctataaatgaattatcagttttaaaatatacatttaaattatttaaaataaaatagcaaatttagatctgcagtctctcaggcatgtgttagtccttctagcaacatgccaagtctgagtagccacaggtattgacacctgcacctgtgggaatggtgaccctggggatgtgcagggtgtaatcatatgcagtggcattaatctttggggagagtcagaattcatttatagcctggtggtggctaagagatggcagaattataataactgaggaggctaagtacttaacatcaatttgcagggcagtctcattttatcaggaaaagcaagaatggcagaggcaagaatgcgatagctgttccttgacattggaaaaccttcagcaaaacccagggtttgggggttccccctgggtgtctgaaatgtagcattcagcactagctccagcctttgggcagctgtgggggccagagaccaagtgtggtccctggcccagggtgggattagacagcataagtggtgtcaagaagtatatgttagagttaatgaagagtaggcagtatgtggatcacaactctagggaccatcaaataaaacttctttcagttaaggcattttgtttactgttaaagaagacaggactctaggatgtgtcttacttttccagaacatgttacaaactgatgtttcttgagattatgttggggtatgctcagccagtctctctcaccgggttctagagacagctgctgctgattttgagggtaaaaatctagtattcattgatctgaacagctgaaagcaaatcccttttgatgcaatcagattgactcaaagcattagacattttctctctgtgcagactaggctaaatgcccttggatagtctgtttcatgggcttagccttagcaatatggacctggattaattactctggcattgtgtaaactctgtaactatgtagaaatagtattatctcctatcatatctctatgtctgaacattatatgcaaccttctgtttattatcacagtaaaaaagtctgtccaaatcattgtatatgcataatttctattatgtttagagggattgatgattagaagttgataggaagacattatttaataattacaagagaatgcattctttaacaaggataatatacctcattaaaaataaaaatcattgaattatttctctactgaaacatatcagtgtcagaaataacatgaccctaaaggatatcagttgtgaataaaagccccaaagtggggattaaagtattaatagtcatgggggtaggtatgattttgcagaggtagaaactgaaatacagataaataactttcccatggtgtctgttgtatgtagtgaagccaggattaaaaaactaaggcctatctaactgtgttttttcataatgaggtactaactatgatacgaatgctccaaagctgtcaaaccacgagaggaataatgtattataccgattattcattcagaaaaacaatacaagtacttcaaagtagcaagaatctactctaaacaccattttcacaggtataaagcaaaaataggatttgatctttgaaaatatctattttaaagaatttagtatattgtgcttttatatcaattatgtactgccttaaacattcatcaagttctgctctaaaatgcagcatctctgaatatgacctgcagcttcatatgctatagacagagtagtcagagaaagtagaaagcaggggcacccattgcctttgaagagttttcagtgaaaaatttaaagaaaaaacgctaatcacagacataatgtaagtatatgaatataactattttcccctaaatctgaacatagataatgcaacataaatctcatgataaagagcaatctctaccttatatagcttagtggagaattagaatataattagtaaatgttgaaaataaagatcaactatgttgatggtattttaaaccattcagttctgtatatcgacattttgccaacactatgctaattctatggctctctttttggccctgagtttacttagtattctccacagtatactctgacctcgcaaatcaacattcatggtacaaaacattaaaagtacagaatatattattgttaagaagaggattcacatgtaaagatgacaatgaaagtgttcctggggaaaactagcaagggagtggaaagtgggatggagaagtaaagtcagtgtgccaaatgtcatggaatgtaaccttggctcagatcccacagggaagctcttgagataagtcacatgtcacagctgtctgaagcaggggctagaagctggagactttatatgcctacatctatcagacgttggttacttttcccaatttcccaactacccttatgttcaggcaagatgggttctggcagcctgagggttgtccgcagacaaaatcttatggattctagctattatttgataaaattgacatgttcacaccttatgccccagcaatttcaatgataggaagacatcccagaaaaatgcctgctcatgtttatgggaagatgtgtattaaaaatatgcagagaagcagtgtgtattgtataataacccgaaaatgaaaacaacttaaatgtccataaacatcatcactgttcaaagcatatgctacattttatataaagaaatacaatttgaaattcaaagggaatacacttcaagtaaatacacatgaaagaaaaatcataatgttgattaaaataagtcatagaagaatacatacaatgtcatttcacttacataaaatccaaaaacaggttaacagtatatactttaggaatatatgcatatatgataaaaccagaaagaaacagaaaggcatgctttattgaaagtgaaggctatcggttacttctaagttgcagggagggagatggtgtcacaggaccaccagatttgtatgcttgctgtgcagtaacagacaaacacactgagacagcagggtttgcaacagagaaagactttaatgattatagggcagctaagcaaggacatgagaacgaccgtcacatccatctccctgaggagttctgggctggagtttttaaggggattgtggagggtgagcggctgtaaaattggggttttgattggttagggtaagagtgatgaaatcatcttgatgcggaaactgaattttttgtcagcttctcctggggtactttggaccagctggtgtcagtaattccacccatatgtaggagctattgtagatcaagatatgaagataaagaagatctagcttctgaaacgcagttctataattaaagaagtgatataacggtatagggacttagagggccgactatgacttcctaggttagaaacatagcttggccacttaaaaactgaataacctcagtagaacctcattgatttcactgaaaatcaacttccttatctataccatggaggtaataatgctgactaccttattcactttgtggggattacataagttaatacatgtaatgcatttcaagcagagctcagaggcaagtgaagcactcattaagaaaacattcttggccgggcgcggtggctcacacctgtaatctcagcactttgggaagctgaggcaggcagatcacgaggtcaggagatcgagaccattctgtctaagaccgtgaaaccctgtctctactaaaaatacaaaaacttagccaggcatggtggcgggcgcctgtagtcccagctactctggtggctgaggcaggagaatggtgtgaacccgggaggtggagcttgcagtgagccaagatcgcgctactgcactccagcctgggcaacagagcgagactccatctagaaaaaaaaattctttttaattatacatgattttgattgcactgaaaaagggtgggccagttgcacctgtaagaaaaatcttattagttttctgttgggactactgagggacacaggatggaaaagcactctgaacagacaaattggcatgtgtgcaaagcattgaattacaaaataacaagggaaaaggtgttcaagggaaagtgatggagaagattgtatgggaggtggcaggagacaccttgatatcatgtggggctgtctgataaatttgcattttgtcttagagctatctgtaattcttaggagattttaaacatggaaatagcatacagactatttcactaataaccaagtatgccttgtggaggatgaactgaattaggacaaagttgttagcaaaagaccactaatagctgtttcaagtgaaaaatgttgatggatttaagtaaagcagggtagaagaaaaagaaagcagattaaacagatatttctgtagaattaactatactccataactgactgacttcagagatagaaagatgctaaattatgctgcagaacaagctaccaccaaaatctcactgatttacaaaaaggaaggtttagttctcactaagatacgtcctggcagctgcagcattcaaaatgtatttgtttgttcattaccatttatcatctctttctctgtcactgttgacaagatagagatacaaagttgttcaaaaatatttcaggtgtaactatgtatacatttgttacatgaattatcacaaccttaaatcttttatttctattgtcttaaccatttttgccacacagaagctattcatatgacaattaagttgatatttttggccgagtgtggtggcttacagctgtaatcccagcactttgggaggctgaggtgggaggatcacttgagcctaggagtttgagaccagctgggacaacatggcaaaaactgtctctctaaaaatacaaaagttagccaggtatcctagcacacgcctgcggtcccagttactcaggaggcagaggcacaaggatcacttgagccggggatggggaggcagaggctgcagtgagtggtgatcgtgccactgcattccagcctaggtgatagagccagaccctgtctccaaaaaaaaaaaaagactttttttgtggcagtgtctcaaacagacacaatctgacataatttagcatgttttctttatttttgacacagggtctggctctgttgcccaagctggagtgcagtggtgtgatcttggctcactatagcctctgccttcttggctcaaacaatcctcatgcctcagcctcctgggtagctgggattacaggtgtgcaccatcagtacctagctatattttttggtacttttagtagagatggggttttgccatgttgcccagaatggttttgaactcctgggctcaagcaatcctcctccctcagcctccaaaatgttgtgattccaggcatgagccactgtgcctggcccataatttagcacttctatcaaatgcaattatgacatgaaatatttctggttaacaactgacaatgtaactaatacaataagttttatttacattttatgggcagattttttttggtgcattctgtagtcatgaacaaattaaatggtcattatcctcatggagattctagcaaaaagcaaattataattacccacattttcatacccagctaagagtcctagaaagcctccaacctgttctagccattttctcatatttgtacagctgcaaaaaaaatatttttgagtacattatgtgagctaaattgtatttcaggtggtagagactatagataaatatcctctttcatacaaactaatcctttcattttgatgcattatttttgaggttcatatgaaccacaaccacatcacttgaattgatgtattggaaatgtgataaacattgtgtccagactgtatttgctatttattagaacttacctctccttgtatgaaattaagtatttgttttagatcaatttctttgagttgctttcttttttcttttttaagtgaaatagaaaatgaagtctgtagaatctggggaccttcccttgactaaaaatgagtttccatagtattaccataaaatctatggtaacccatttcatactgaaagattcttgattgcttacctgttgatgtcattccctaggtgacgtctccttaaagacattattgtatcccatttttatttgtatacacagcatctaacatcatgtccagcatagaatatgtgtctaataaatgttggttggttgaaagataattttcatctgcagtttctttatgcacattcgagtttagtatcttctgaattattgttttgttttatatatgacttacatgcacattaaagtaagaaattttccaaagagcttgagtagcgctaagattggtcattttcaagcatatcaaaagacaatgagtgaaaatactgtagctatactttattactctgcaagcgtatgactaaatgcagctgactcctccacacaaaattaccatagtggttaagagtgagattttagcctaatacctaagtctgaacctttctctgctgctaactcattgtgtgatttttgtgcaaattacctacatttctggacctctatctcttcacttttaaaatggggatcactttgataattgcacctatctcacagagacattttcaagatcgaaggagtttaatagtgtataaaatttagtaaaattcctggtacatcataattgctatgaaagattggttatgggactcaacaaaatctgttaaataaaaaaagtatgaaaatatgaaaatatataataacatagtaacatactacaattatgaatatggactcagttctaattctgaatagtagggaatgcatttggaattattagtaactaatatgatatattcttttgtaataactatatttttccatgcttaggtactgatcactcaggattctagttgtgaatgatagcagcaacactagctattcaaacagaaagagatttattaaagggacttttttactgaagtttctagacagctacaatcagatttgaaatgccaccaccaagaacaacacctacatctccccagagctcctcagtgaagccagcactgctatacccactgctgtagatgcctgatgattctggcactgcgtgccaagctgcccggggtggcctgggaagaccagctggctctgaccctagccttgtcagaaaatcagtttggcacagaaattgctttatctctctagaaccaaagtcttgtgtttttctttctgttgggcatttaagtcaaatacctctactctagctgcaagggaagctgagaaaatgaacttctgaaattccccaaaatatgcaggttgttcaaagctgctccctggccaccaaggtgtcctcaggcacagagacattaactagaagaggattccttgagcgccacaaataagaacttatggggccttatttagttgacaggggtgaacagtacctggaatatcagttgtaaatgtaaggagaattctcacatagagtttaaattgcttaactatattcaattatttcaaaaacatgaaacgaattatactagatataatctcccataggatttactgaggaatacagagaagagtaaaacaccctgctctgattcttacagtgagcaaagaaggtgtcaggagtagagaattttttcccacatgcaatgtgggaaaagtataaagtaccctacagatgcattgaaggaaactcctctctttaggaagaataaggagagtctgaattgatttgctggttaagtgtattggtctgttttgcattgttataaagaaatacctgaggctgggtaatttataaagaaaagagatttatctatacaagcatggcaccagcatcttctcagcttctggtggagccttaggaagtctttacccttcatggaggatgaaggggtgcaggtacatcacatgatgacagaaggagcaggaaaaaggaggaagtttcaggctcttttaaacaactagctctgacatgaactaatagagtgagaactcactcagtaccaagaggacagcaccaagccattcatgagggatccacccccatgatccaaacatctctcactagacgtctgagaccatctccaacatttgtggccacatttccagatgagatttgcaggggtcacacatccaaaccatatcattgaccaaacatttattgaatttcatattaccaatgaaggtacaaattaagtaatatatgttccatggaattattaaactttctccacatgttgaaagatttattcaggcataaaaagtttctatttccaagaaaggtacgtaagtggaaatatatagagaattttcagggaaaaatatgctttttaatttgactaaaaagttggttagatccagaaatatggtgggttctttgtgaatgccataataaagaactgaggcatgacactcattttattatttttaattgtttttccagagaagaggctgacatggttaaagtgtgttgttaggagatttccattgtcaatgtggtacagatcaaataaaagtgagaaagctcttttattataccaaatagcagatacggtgaattttaaatgcttcatggtaaagagaatagagtggaaagtgagatgcagatgacatagattctatggttctagaataaaattattaattttaatgaatgtgtggagcaagacagatatgaatctcagtgaccatgctggaaggactgtggtgttatttacatctatagaaacatgatggaaaacacattctggaatttagaaaaaaatttagatagaattgttgtgttgaatgaattatatttgttttctgttgctggataaaaaattaccataaattcagcagcttaaaacaacacccacttatcaactcacagttctataggtcagaagtccatgtggaccggactgcattctctgatatgggtatcatgaggtggaagtggatgtgttggccggactaaggtacttggaagctctggaaacagtctccttttagcgcattcagattgttgacagatcagtttcttgcagctgtagaaatgaggtctcagttttcttcagcaatggaaaaccccccttacatcaaatccctgtcttgatttcagtctttctgatttctgcttttgctggcagtttagaaaatcactgcttattttattagattagggatatgatttggctatgtgttcgcacccaaatctcatgttaaattgtaattcccaacgttgggggagggacctggtaggagatgatcatggggggcaagatttccaccttgctgcttttacgatagtgagtgagttctcaggagatcaggttgtttagaagtgtgtagcacatccttctttgtttcctgtctcctgctccaccatggtaaaacacgcatgcctcaccttcaccatccgccatgattgtaagtttcctgaggcctcccagccctggttcctgtatagcctggggaactgtgagtcaattaaacctcttttcttcataaattacccagtcataggtagtttgtttacaggagattgagaacagactaatataaataggctcttcagaatactttctctatcataaggtcaattgattactagacttagacaaatagtgtgcagctggaagtgctctctggaacttggaagaggattgaagtaagagatatactctgaagagtgaattattccagtagtgctatgaagagaagtgactgacataatcaatgaagattatattgagaagcaaaagtgaaaaatctgagatcttgcaggtaaaaaataaataaataaataagtcttagtgaaaagatctcaatttcatttatgggagtaaatgccaggaattgagagcgggaggtaaaatatgtattgttagacttgaggaggtcatgattcttgaagtggaatgaacgtgcacgtctaaaacacctaaaagtaacgggaaaataaaagaaatgaagaaagaaaagaataacttcccagatatctagcaaaagggaagcaatagaatacaccagctgagggacttgtaaggaacacatcatctgaggaaacgttcattgcagtaaaatgagaagatggaatgtgaataagataaaaatgcaaattatgtagaaagcatagttgcaagaacacagggtggactagagacaaaaagggcttaggaggtaaagaacaatcccctagtgcacataatctcttgttttcatctctttgccttggatcacgggccaatcatgacagcaatggtgcattttcatctttgaatccatgacacattgttggccctcaataaatttgcattaaacaaatgaaaagcaggtaaccagaagcgatctgtgcctacaagaggagctgtgtgtgccaggaattagtctagcaggagcttggtagattatacttcctggaaatatagatgcatataattttaaagatataatcatgaaatattaaaagaattgtaaaagtggcagtgaattatttagaaacagtgtccctgcatgcatgatacaatattcagatgtgtgttaaaatgtatgctccaaggaaagtcttggtatagttttatgtgcgctgcatattttcaaataatgctggaaagcagtttaaagcttttgaatttcttcatcccgttttcctgtctccttgtagagctccctttgatttcaaaggtgcttcattgctagaatgagaaataggtggtaggaaagtttaattctttgaggctaaagtttgaaacagtttttcatttacagataaaaattctacctttggacttcagcattgttcagttttccccgagataaatccgtagaagtagcctacacctgcctacaccttgtgactacatcttcagattatatatatgcaggcacagttttagaaatgggctggcaaaggaagcaagagggaacagaagataagatgctcccctcctctgtaaaagagatactgtaatcatatgattgtgtttttagccaccgaaagcaaaaaccgactgatattacctttagatgctaatgatttatttgatagaaatacatttttgctttaagcttattgatcatgctcatttataaatgtaaatttattctgtcatcaggattccaaatcatttaaaacctacaaatatttattgaatgtttcttgctaaactctgtggttggttttgggaggatgtgtaaaatccaacacttgatctccagggattttcatcacctaggaaggagagataaatacattttctttttgaatggaaaactaacatagcaaaagaaacaaaaatgctataaatattcaaagtatgagatgttagtcctatcacatcctttgttgtatgaggataaatataagtaaatataaaaacacttatatacatggcagatatcacttggtattaattctccttcagctcttggaaaaataaatcttattgaagagccctataaacaccacttctcactacacttactgcataattttagaaagaggtttaattaacatgaaatagctacactcaactggtctaaagcagctgtgtagcgtgaaagtcacacaaagccccagtctcaatgatgtattcctcttcccacctcaatcatcataatccactttctgtggtactccagtaagttcagggaggctttctttcaatactgcaagtcctcattgtcctcctcttaattctcataccttttcatttcagaattctctcttggatctttgatagtacttgtaccacctactggctcaaacatttattttagttgctctgaaagcacaggaggcgaacaagaggcaaaagtggagactttgggcatagtggccattgggtttgtggcagatttttctggcccatctcagtaaagaaaggaatcatagtgtttggggtcttaaggagaggacaaggaagatatgagccaggtatcagcatcagagagaccatatggccactgaaatctcaaactggatcatagcatactgacagtgcttacatggcccgcattccttgaattctgaaccctcaagatgatgaaacatggagaaatagctgatgtaaacttataaatacataaatcattaggcatagggtaggcctctataaaattgatagttgaattgtgactcatcacttgggattggtgggttacaaatgtgtaaagcctcaggatttgctctctgttttcaccttaatttgcttatttattaaatatgtagagagcagggatgaggaaccactagcctgggagcaggatccaattctcaagaagaagtaattgtttattatagagaagtaaagtagcagaatgaaagaggaaagaaggaaggaacagcaagagggagggatggatgttaatttgccccacttgggtcaagtctaccactctctactccatgtctataatattaatctctgtgtcataagggaaggttctgtgactggcagccacaccgtaactagttggaagagttgtccaaagcaagttagtttgctccttctgaaaaaaggagagcagttgtagaaagtttgcacaatgaaaaaagtttatatttatttgaactgttgtattagtcttcctattattaacagagactagccaggcagcaatatttaactatgtgaataataaagaccagaagtcaattttttttaaagaaaccatagctggccagaataattaaagctgcatgttttcacagtttgaggttctgttaagtcaggaattaagtcattgtcgacacaagataggtcaatctcatttagtagcatgccattgtaaattaggtgatttctcatcactccttgctgctccatgatagtacaaatgcttgtcaaaagctttaatggtcataggtaaaacactaattatgtatcccacaatagttgttacagtaaggtaattctttgtgtctctagggtaggtaaatgtttcagttatatatttgcaatgaaaactgaggacagttacagtggctcatgcctgtaatcccagcactttgggcagctgaggtgggtggatcaccaaggtcaggagttcaagaccaacctgatcaacattgtgaaaccctgtctctactaaatacaaaaaaaaaaaaatagctgggcatggtggcatgtgcctgtaatcccagctacttgggaggctgaggcaggagaatcacttgaacccaggaggcgggggttgcagtgagccaagattgcaccattgcactccagcttaggcaacaagagcaaaattccatcaaaaaaaaaaaagaaagaaagaaaatcgggtaccatcctatcttgatgaacacaaatgtgtagaacctcaggatttactctctgttttcaccttaatttgcctatttatcaaatacctgtagagcaggaatgaggaaccacttctctgggagcaggatccagttctcaagtttgattttatctaatctatagagagttggtattctgccatgaaaagtaagtctttcaaattaatgtccttaaaatgcccttcatctggtccaatcagaacagagtaggagaaaacagtgctagagacacagattctcagttagactttctgatttaaaggcccaactccaccacatgatggagtgtaacctgaatgacttagtctctctgtgtgtgtttctgttttatctgtaaaagtggtataatactaggacctacctcatatagttcttatgaggattaatttggataatatttttaaaaatgtttggaacaatgcttggcaaacgaaagcaacataagactgccccttaaatgaaaaaatgaataaataaacaaagttcctcaagttttaagtacatgtaaaaagcttttgtgagctaatattttatagctattaaaattatacaaatggtacacatttattataaaacattcaagttgaataactgaaataaattactcataatcttacaatctggtattgatagtattttagcgtatttttaaaatttttgtacatcaaattagaatcttacagtttaactgtatattctcatttgtaatggtattgtcttatgtggaattctataagcattattccatagtcttacatattttaataatatattttttaactaattccttgttgctagattatgagctttgttacatatttagataggttccaattttgtcactttttatgatgctgtaataaacattctttatgaaagtctttgcccacttttggggtgatgagagcacctggaaatgaaactgagaaaaagagaggaacatgtaaattatttgatcagtaaatctataaatattatgccaatttacatttgcagtatcattattacctctcatggtgacaatgtaaccgaattttaccaaggtcaattttccttacctaacccacgctttggaaccagctgagccttctctcctccaggtctcttcccatgacctcttttccctccctctacttgtctttagtcttctctcctttgtctctccatctctgtattttcttcttttcagtcctttttatctgattctagttgctgctaaaaaaatatatatgtctcatgaggtatgttcttcccaacactcatagactttattctaacttcagagtaatggctgtctgcccactccttcctttgtaagtaagaatctgtgacttgaagaatcacattttttcactctggcatagtacatttgctagtggtcttaataatagtgggccactagaaaagtaagttttaattgtgtttttaactgtggagaaatgataagagatgtcttcgaaaatagcaaaattattgataggatgtttctgctgcagcctacaaagttagttacttttcactggagactgagtttattacatgagcggcctgtcttaagtttcttgccatctctcaagcacattctctaatataatttattcattgaagcatacaactgtgtttctgccttagggctttattttcatctcctcacaatatacaaaattaaaccccaaagacaatagcattatatgtttcaaataattcttcaatagatatttgtaatttatatttcatgcaatataacaagatgctgtgcattgattgagagcactgtagagaatgtaaactaaactgtaaaatgtgtccagaatatatttcaactaagatggttttatcagtctaaacttaaaatgtgtttcaaaaatcctgcaataccaggattctgcatctattgtgctgattttgctcacttctgactttgtaactttttctgaaggaatcacatttttaaaaatttttaaatatgtaattaacaaaaattgaatatactcaaggagtacaatgtaatgatttgatatttgtatgtacgtttgcaaggattatcaaaatcaagttaatacattcattaccactcatgctgtacattagattcagacttgttaatctaattggaagtatacatgatttgaccaacatctccccactttcctagccccttgaaactatcattctactttctgcatctatgactttgacagttttagattccacttataagtgagattgattgtacagtatttttctttgtttatcaagcttatattcataaaatgtccctccagttcattcacgttgtcacgaatgacagaatttccttctttttatggctaatattacagtgcgtgtgaatgtgtttgtgcttgtgtgcatacatgtcacatttttgttatctatacacctgttgatggacacttatgttgtttccatatcttggctattgggaataatgttgcaaaaagcataaaaatgcagatatcccttcaacatactgatttcagtttttttagatttgtacccagaagtgtgactgctggatcatacagtagttctatttttaattttttgaggaatctccaaactggtttccataataattgtatcagtttaaattcctaccaacagaggagtataagcattcccttttctctacagcctcccaaacgttgttgtttcttgtcttttgataatagccattctaacaggtgtaatgtgattgtcttgatttgcatttctctgataattagcaatattgaacacttgttcatgtatctgctggccatttggtttttcatttgtttgttttgttttgtttttgagatggagcctcactctgtcacccaggctggagtgcagtggtgcggtgtcggctcactgcaaactcaacctctcaggttcaagcgattctctttcctcagcctccagggtagctgggattacaggcacccaccaccacatctggctgatttttttgtatttttagtagagacggggttttaccatgttggccaggctggtctcgaactcctgacctcaagtgatttgcccgcctcagcctcccatggtactaggattataggcttgagccactgcacttggtctctgctggccatttgtaagtcttctttgaaaatgtgtcttcactttttagaaattgttttgtaattgagttccttatatattctagacattaaccctttatcaggtttaaaaatattttcttccattccgtaggttgccttttcattttgttgattgtttcctttgctgtacagaagtttttagtttgatacagtcccacttgtttatttttgcttttatttcctgtgattttggtgtcttatccaaaaaatcattgccaagaccaatggcaagaagcttttcccctaagttgtttcctagttgtgttacaatttcagctcttacatttaagtctttcatacatttggagttaatttttgtatatggtataagacgagggccaatttcactcttttgcatgtggatatccagtttttcaaacccatttattgtggagacatctttttcctcattgtgtattattaatggcattatcaaagagtagttgatcagaaatgcatgggtgggtgtttttctgtgctctgtattttgtttcattggtttatgtgtctattctatgccagtaccatgctcttttgattactacagttttataacatagtttgaaattcggaagtgtggttcctctagctttcttttttttttttttttcaagattgctttggtattttcatttatttggggcttcttcaatatttaatctgtaccttatagtttttagtgtatggacctttcacctcctaggttaaatttattcctgagcattttattgtttagatgctattatcatgggaacattttcttagtttatgtagattttatatgtagatttcgtatctgcaactttactgatttagttttctagttataaaaggtaaagtctttagggttttctgtatatggtattatgtcctccacagagattatttaacttattttccaattaggatgctttctatctgttttttttttaaacccaactgctctaacttggacttccatactaggttgaatagaagtgacaagagtgtgcacctttgtcttgttcttaatcttagagaaaacgaattaagctgttcaccattaagagtaatgttagctgcaggtttgccatgtatagcctttgttatgttgaagtatattcattctacaactattttgttgagaatttttatgataaaagaacttttaattttgttaaatgctttgttgcatctattgagatgatcatatgatttttagccttcattctattaatatagtatatcacactttctgttttgcatatgttgaaccatccttgcatctcaaggataaattccagttgatcacagtgtagaccttttaaatgaactgtttagttcactttttcagtgttttgttgaggagttttacatctgtgtttattagaagtattggccagtgattttcttttcttgtagcatccttatctggctttgatatgaacgttactggccttgaaaaattacattggaagtgttcccatctcaatttttgggggggagattttgagaagaattggtgttaattgtttgttcttaaatacttcataaaattcaccagtgatgccatgtgttttaggctttctttgtttttaatgggaagttttaattactgatttaatctctttacttgttattgatctcaaatagcctatttctttatgattcaatcttggtatattgttcatgtctaggaatttatctgtttctttgaacttatctaatttgttggcatataagagttcatagtgatttcttatgatactttgtatttccgtggtatcggttgtaatgttttctttttcatttataattttatttactttgttagtctttttttctttgttagtctagctaaaggtatataaattttgtttatgttttcaaaaaaactcagtttcattgatcttttctataggcttttctttatttctagtttttatcttattatccaatctttttcccctttatcaaggaaaacttctgataaggtttagctgtgtctgcacccaaatcctatcttaaattgtagtttccataatcctcatgtgttgtgggaggaagccagtgggaggtaattcaattttgggggtggttactcccatgctgctgttctcatgatagtgactgagttctcatgagatctgatggttttacaagaggcttttttctctttgctggtcttctctctcttgctgccctgtgaagaaggatgtgttgtttccccttctgccatgattgtaagtttcttgaggcctcctcagccttgtggaactgtgaggcaattaaacctctttcctttataaatcacccagtctcaggtatgtctttattggcagcatgaaaatggactaatacagtaaattggtactgggagaatggggtgttgctgtatagatacctgaaaatgtggaagcgactttggaactgggtaacagacagagcttggaacagtttagagggctcagaagaagacaggaaaatgtgggaaagctcagaacttcctagaggcttgttgaatggctttgaccaaaatgctgacggttatatggacaataaagtccaggttgagttggtctcagatggagatgaggaactcgctgggaactagaacaaaggtgacacttgttatgctttagcaaagagactggacgcattttgcccctgccctagagatttctggaactttgaacttaaaagagatgagttagggtatctggcagaagaaatttcttttatatgtatatatatataaaaaatatatatatatatatatttatactttaagttctagggtacatgtgcacaacatgccagtttgttacatatgtatacatgtgccatgttggtgtgctgcacccattaactgctgaagaaatttctaagtggcaaagctctcaaggaagcagagcataaaagtttggaaaacttgcagccccacagtgtgatagaaaagaaaaacccgttttccagggagaaattcaggctcactacagaaatttgcataagtaacatggagccaaatgttaatcactaagacaatggggaaaatatatctagaacatgtcagagaccttcatggcagtgcctcccatcacagacccagaggcctagaagggaaatattgtttcctggactggacccagggtccccctgctctgtgcagcctcgggagatggtgccctatgtctcagctgcttcagcaccagctatggctaaaaagggccaaagtacaccttaggccatagcttcagacagtgcaaatcccaatccttggtggcttccaggtaatgttggtgcacagaaggcaagaactgaggtttgagaacctctgcctagatttcagaggatgtgtggaaatgcctggatgtctaggcagaagtttgctgcaggggtggagcagtcatgaagaaccactgccagatcagtgtggaaggaaaatgtagggtcagagcccccacacagagtccccactggggcactgcctagtggagttgtgagaagaggaccactgtcctctagaccagagaatggtggatccactgacagcttgctttgggcacctgcaacagccacagtcactcaatgccagcctatgaaagcagccaacagaagggctataccctgcaaagtcacaggggcggagctcctgaaggttgtgggagcccaactcttgcatcaatgtgacctagatgtgagacatggagtcaaaggagataactttggaattttaaggtttaatgactgccctattggatttcagagttgcatagggcctatagcccctttgttttggccaatttctctcccacttggaatgggtgtatttacccaatgcctgtacctccattgtaactagaaagtaactaacttgtttttgattttacaggcttataggtggaagggacttgccttgtctcagatgagatgttagacttggacttttgggttaatgctggaatgagttaagactttgggagactgttggaaatggatgattgtgtttcgaaatgtgaggacttgagattttggaggggtaaggagagtggaatgatatggtttggctctgtctccacccaaatgtcatcttgaattgtaattcccataatccccatgtgtcatgggagagacccggtgggaagtaattgaatcatggggatggttacctgcacactgctgttcttatggtagtgagtgagttctcatgagatctgatggttttatgaagggcattttcccctttgcttggcacttctctctccttccaccttgtgaagaaggatgtgtttacttccccttccatcataattgtaagtttcctgggtcctctcagccctgcagaactgtgagtcaattaaacctctttcttttattaattacccagtctcaggcagttctttatagcagcataagaactgactaacacaacttcttcccagaatatacccagatataaatgaaatagataataaatcaaagtcagctgtactgagtttgaatgagactgatggtctcttgagcccagagtttagtttctaacagatctggaattgaatctaggcttcttccctagccatttcttggaggtagcccctttggaagtatgactagacctttccaatcattaatctctttgtctctaaagtaagcataatatctacttttttagggctgtgttttagtattaaggaaataacctgtttagctcaatgccaatcacactgtaaatattaagttaatggaaaaaatgctaaaaataaaattgataacaataatatagagaaccttttggcatggttgtctaaataagagaatagataaaaaaagaagtgcaaactatagaccaaatgtttggatctcatattagtttagcatttggaaactggctatagaactagacaattaatattctttgctaataatctataacatttgttaaacagttcgaattacagtagaaccaccaagaattctgaaaacccagtaagttaagttgatgacatgactggctgtctggatgctacggggcatgagctttagccatactcattaactttgataccccaaagtcaccccaaagaaatacaaatacagtgtattaggtatgcaatatccgcttcaagacaaaacttacagtcatttctggtatgatcaaattgattcccctaagtccttgttataggaaaaattatgacacacccacttatcagtaagacacgaatgtaacatttcctgagatttataatagttattgagaaaaggaaaagaaaatttatgaataatagaaataattttcctttatgttttgaaaaattaactcttatttttcagttatcgaacatgtaccttcaattcttcaatttagagtttatttatgataactaactttgatatcctctgagagcatgtctagaagatggcaaatgcttttcaccatgaattagtgctgaatgcagttttaaaaatcttaccttgttaatctgttagaagatagtagcaaataacaataccacattgcttatttgttgaatagcaacaatttcaataattcagtagaagacataagttatatgacagatatatataatcataaatctaatatatttgtaatgaagacaaatattagcttatatgtatgatgtttaatcttactttagactctaaataactgtgtgatattggaaatttactgaaattcgtaatgattatattttatttctttgtaaaatatagtaatttgacttaatgatctctatgattacattattctctaaatctggtaaaggtgaaactttagaaattgtgtgtgtgtctatatatatacatgaatacatgtgaatatattcatagacacatacacatatgtacacatacacaaacatatattcacatccatatatattttttaattgggtagaatatggagtgaggaaacttattgtattcacaaattgagtacttagtaaatatttcatagatttattaaataattttactttatgatatatattagcaagttccctgtgcttccctgtgcacgttttgaagattaaatgtagtaaaggatatagagcactttttttttattatactttaagttctagggtagatgtgcacaacgtgcaggtttgttacatatgtatacatgtgccatgttggtgtgctgcacccatcaactcgtcatttacattaggtatttctcttaatgatatccctctctgctcccccaaccccacaacgggccctgatgtgcatgatgatccccgccctgtgtccaagtgttctcattgttcaattcccacctatgagtgagaacatgtggtgtttggttttctgtccttgtgatagtttgctcagaatgatagttgccagcttcatccatgtctctacaaaggactttaactcatccttttttatggctgcatagtattccatggtgtatatgtgccacgttttcttaatccagtctatcattgatagacatttgggttggttccaagtactttttatatgtctggtactcatggtatgtgctcaaagattcagagaagttatagcacttcaatgtgagtctgatagtcacagatgcatcattatgaggatagtgtgcctgggatgaagggaaaggtagagaggaggcagagaagaaatgccctgagggtccagattggaagaggattcggtggagagaacttttcatttcaagaacaagagaaaaagagtagaaggaactcagcctgaaagtattcccaatcgaggacctcaccaactgactgcccatgccgggaacagttggccatcccacagtctaagagaaactaatgggcacacactgtaaaatgtaataggagtttaatgtaaatgggtatctagactttggaacttgggcgtataccactaaagatgttaacctaaggaaagtatagagttatcagtaataacatgtcagtttgtttcttgtttggttggtttgcttttaaacagtaggatagactgcttgctatacacatgttagaagctttgtagttgctaactggcaggcagtaaagcacggtggttaaaagtcatgccctgggtcaacatactagctgcttttcttactatccatgtgatctgtggcaacttacccaacctgtctatgcttaagtttctttaattgtataaaacatgtgcaatagcacttgtctcctacagctgtttcaaggattagctgagtttacctgaggaaaatatcatagataataagttcccaataaaagctgttactttaaaatcatttaattcaggtctggagaaaaacaaacttggaaaataccaaaattgagaggggaaaggcaggatgaaaatctcacagaaaataaatggttagagttgatggacgaccaggataacacagtgtctctgatccccagatagtatagaatagaaaggaaaaccctgttacataaacagtgtcaaatactgtattagactgttctcacactgctataaagaaatacctgggccaggtgcggtgactcacccctgtaatcccagcactttgggagactgaggcaggcagatcacgtgaggccaggagttcaagaccagcctggctaacatggagaaaccctgcttctactaaaaaaacaaaaaattagccaggttggtggcacatgcctgtaatcccagctactcaggaggctgaggcaggagaattgcttgaacccgggaggcggaagttgcagtgagccgagatcgtgccactgcactccagcttgggcaacatgagcgaaactccatcaaaaaaaaaaaaaatctgaaactgggtaatttatataaaataaaaagaggttttattggccatggttctgtaggctgtacagaaagcatgatgctggcatctgctcagcttccaaagaggcttcaggacacttacaatcatggaagaagacaaagagggagctgacacgtcttatttggcaggaacaagagcaagaggaagggcagggagatgctactcacttttaaacaaccagatctcgtgagaactccctcatcatgatgagaacagcaccaagaggatggtgctaaaccattaatgaaaaaccacccccatgatccaatcacctctcaccaggcttcacctccaacattgcggattacaagtcgacatgagatttggtgggacaaagattaaaaccatatcaaatactaaaatttaaagattaaaaactgaaatcagaaaaaataagccaactagaaatttgttaaaaaaagaatataagatattgattgaaaagtaagttattattctgtgtcacttccatataaaacattttttaattggcatgaatatttagagttaaataaatactagtagtgtggttaagggtttctgtactttatatttttcctcatttgtttatagtgttttttctcaaattttctttcttttctattaactttaaagattctattgattcttgtaccaatagagagttttaataggtttatgaattggcaagttctctactaatggatggtgagaatgattcatctttaaccccaaattcaaataatatcaagagactgttaaaatggtgcatgacgattttagcctttgtttcagtattaaactagtggcacttcattaatttttaacgggattcaatttgcctgttaagtagtttatagaatcatcttacttttggtttcctaagaaggccaaagtattttgcatactcctttctgtttagcatattttttccatgtctctccatgaaataaaaccacatttgacaataacttaagattggtattgtcaagtgtttgcaacctttaggggtcttttgttttaaatacctccatggaaaaagaaagcacacgatgcggaatcggactcatcagaactcaaactgatttctgttactagctctctgtggcctgggcaagtcacctaaactctggaagattttgtttttagcatgtgtaaaataggaaatttgataaatgtaacatttaagtgtattatgacatgtgaccactaaatgaaaacttttgttacaagtattttatgggaataatgactaaggattagcattcttgatatttaaaaagctcacaaattggataagaaaaacgatatcacaaaagctaaaaagagattattcagttaataattttattattagtgtatgtatgtaaaatatttaacatcactacttaacatttaaaaagtaaaaaccacagtgatattcattaaggtaggtaaatttttaaataatgataaatataatacaaaaaatgtggagttttattctataccaatcctgaatcatattatttataattttacctacttttaatcaatgtatattcagattcatattctgctttttaaaaataatttgaaaataatacatattatttatatcagctataaagtattctatatgatcattctatctcaagttacccaactttcccttactgatgaaaatttaaaagtttccagttgtagttgattatgaatagtggtagatggaagcaatgaacatattggtgcacattatttcctcatttaagggaagtgatgacaatggtagttatttctatagtaatgcagattccatgactgggaaattggagtttgtgaatcaaagacattattctatttttacttgaaaagagtgtgttgccacattatctcacaaaatgatacagtgaccacttcctccatctagaaaacttttctccttggctaccacaatgccacacactctcacagttttctttctctctcacttggcattccttttctttttcctctaaatagttattagacattggcacgtcccatcaagtcttggacagcacttctttcactagatcatcccatctaatctcatctttcaataccattcagctactgatgactcctaaatttatgtcttaatttcatcttcctgagacccaaactcatctttaaaaccgatatgggaacttgacacctcaagttaagactaaaacacagctcctaattttcatccccaaatctctttctctaatcgtttttttccgtttcaggaattgctactaactcacttcaagtttctcaactcagaatgtctagaagtcagccttgattccttcttttcacttgccatagtcgccaggagctctcaccctgaaatacaggctgtcaggatgttctgagaatactctcatatatccacttcttgatacatccacctcaggccaactcactcactatttttacttttccctgttattgttggaatatccatacaacttattcttgatgtagcagttatagtggtattttcttcaccaaataaaacaatgtttacattgtaatttgatcagaagatgctaaatagatatttcgagcagtgctcattgaggtatgtagagcatctcatgctttctgaattaaaagaacatgtacagtgtacataatatttggtcagggaccctaagactggtgagttttatgttttttcagagtggtaaattagttaatgcaaagcaggtgttcatttatagcttcaagtaggaaaattcactgtcctataaaaataaattttataagcactgtagctatcacaaagttaatattatgttttgaggaattaataaaaaaattatatagttagcaattgaatatttaatctcttgttcctgtagtatatataagtaaatataaaggaaaatggaaaaaatagacaaaacatacagacttttaaaacctcagacatttgtcagtttccatgtagttgagcggttttgagtgagtttcttagtcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctgtagatgtctattaggtctgcttggtgcagagctgagttcaattcctgggtatccttgttaactttgtgtctcgctgatctgtctaatgttgacagtggggtgttaaagtctcccattattattgtgtgggagtctcagtctctgtaggtcactaaggacttcctttatgaatctgggtgctcctgtattgggtgcatatatatttagaatagttagctcttcttgttgaattgatccctttaccattatgtaatggccttctttgtctcttttgatctttgttggtttaaagtctgttttatcagagactaggattgcaacccctgccttttcttgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttaccccatttacatttaaagttaatattgttatgtgtgaatttggtcctgtcattatgatgttagctggttattttgctcgttagttgatgcagtttcttcctagccttgatggtctttacattttggcatgtttttgcagtggctggtaccagttgttcctttctatgcttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatgttggagcttctgcacagcaaaagaaactaccatcagagtgaacaggcaacctacgaaatgggagaaaatgttcgcaacctactcatctgacaaagggctaatatccagaatctacaatgaactccaacaaatttacaagaaaaaaacaaacaaccccatcaaaaagtgggcgaaggatgtgaacagacacttctcaaaagaagacatttaggcagccaaaaaacacatgaaaaaatgctcatcatcactggccatcagagaaatgcaaatcaaaaccacaatgagataccatctcacaccagttagaatggcaatcattaaaaagtcaggaaaaaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacagtagcaaagacttggaaccaacccaaatgtccagcaacgatagactggattaagaaaatgtggcacatatacactatggaatactatgcagccataaaaatgatgagttcatgtcctttgtagggacatggatgaaactggaaaccatcattctcagcaaactatcgcaaggacaaaaaacccaacaccacatgttctcactcatatgtgggaattgaacaatgagatcacatggacacaggaaggggaacatcacactctggggcctgttgtggcgtgggggcaggggggagtgatagcattaggagatatacctaatgctaaatgacgagttaatgggtgcagcacaccaacatggcacatgtatacatatgtaacaaacctgcacattgttcacatgtaccttcaaacttaaagtgtaataataatacaaaaatttaaaaaaaaaaaactcagacatttgtcccaccttcccctgtttttaataatgctcgttgttttgttcctacagtgtctgagtattaagtattttctaatgagaccttttgtgaattagatggttaacgaaagagtgaaaacattacttatcaaaatactaataaatatttaaatataaatatacttattcttaagcatatttatatataaatattcttaagtatacacttaaatatatatacttaagtatatatatttaagtgtatacttaagaatatttataaatatactcattcttcagcatatttaaatataaatatactcattcttcagcatatttaaatataaatatactcgttcttcagcatatttaaatgtaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagtatatttaaatatgagtatactcattcttcagtatatttaaatgtaaatatactcattcttcagtataattacatgtaaatatactcattcttcagtataattacatgtaaatatactcattcttcagtatatttccatgtaaatatactcattcttcagtatatttccatgtaaatatactcattcttcagtatatttccatgtaaatatactcattcttcagtatatttccatggaaatatactcattcttcagtatatttacatggaaatatactcattcttcagtatatttacatggaaatatactcattcttcagtatatttacatggaaatatactcattcttcagtatatttacatggaaatataccattcttcagtatatttacatggaaatatactcattcttcagtatatttacatggaaatatactcattcttcagtatatttaaatatgagtatactcattcttcagtatatttaaatatgagtatactcattcttcagtatatttaaatagttgagtcagtattatatcttctaattaggtttctaataataatttcaaaaactatgacatgttttcttcccatttttttatggctgaatcaaaatgttgagatttataacttggaccccgtattctataatgtcacacagacatatatttttttaaattttaccttaagttctgggatacatgtgcagaacatgcaggtttattacataggtacatgtgccatggtggtttgctgcaccaattaatatgtcatctgggttttaagccccacatgcattaggtatttctcctaatgctctccctcccccagccctccaacccctgacaggccctggtgtgtgatgttccccttcctgtgtccatctgttctcatttttcagctcccacttatgagtgagaacatgtggtgtttggttttctgttcctgtgttagtttgctgagagtgatggtttctggctttatccatgtccctgcaaaggacatgaactcattcttttttatggctgcatagtattccaaaaatgtatatgtgacacattttctttattcagtctatcattgatgggcatttgggttggatccaagtctttgctatcataaatagtgttgtaacaaacatatgtgtgcatgtgtctttacagtagaatgatttataatcctttgggtttatacctagtaatgggattgttgggtcaaatggtatttctggttctgcatccttgaggaatcgccacactgtgttccacaatggttgaactaattttcactcctaccaacagtgtgaaaacattcctatttctccacatccccttcagtatctgttgtttcctgactttttaatgattgccattctaactggtgtgagatgagatctcactgtggttttgattttcatttctctaatgaccagcgatcatgagctttttttcatatgacaaaaatatcttataactaggtttgattctagtccagtatgctttttgttataatatgttacttaaagctcagacaggaaatgcaattctattttggggaattaaaattagtgatgtggtggtcataaagatgtgggaaaacttttaggatagtagaagctattgtccttattaaggtgtacaaagaattttggacctgttttttttttttttatttgattttcaattattttctctacattgtcattttagcccattgctatgtcaaccagtttcagcttgccctatgggggaaaaaagcctattaaagaaattctttacatgaagaattgatatctctgtgtttatgaatgtaacactttcagaagattgcactgaaagcaactatatttacaaggcttatctgtcctgtgtgtgtgtgtgtacttatcctaatgttgttaatgttgtttctcattcagagccttgtgaagtgggactgctacacacattttaagttaatatcaaaacacacccacaatgcttttggtgaaattgtttcatgttgccaagtatacatatgccaaaaatctcccctctttatcaaaacagatacgatagttacagtagttagtcattgaagtagctggatatgtgtgccattcaccttcataggaatcagagggattgtaagaatgaacttgagaactgcattcttgccatccaggaactagggttaggattggaataagtaatgtgtgtagcaagtgccagccaaagagaagggaatcactcactatgcatgagtcctggggaagatcagagcactcataaaaggcatttgagttagatcttaaagaatttgtttactatatttaaccatattgatcttgagaacaattcctttgtatttcttcctcaaaaatgaactaaagcagataaagtctttataacctatgttttcaagtatatgaaattactatatcatagtctgagaccaagtgtacaaatatgaaaagtggagatacaaagcaattttccacttactgcaagtcagagcaatatctgtctcaattgtcatgagattttacttgaacatgacctcatctttttgtcctttcatgtgtggtcgacctagcttcaaaatcattgtatagacagtacattttccttatattgttgcacagatcactggcaattttgcatcattgaatgcaacattgtatatcaaaaattggcatatataaattatatcactgcacacagggcagacaaatttgtacacattgttttgcatctatttgtatataccattgacattattgcctgtttaataatagattttgttaatgcacagataataagtacatttcttttttgctattctgcatttttttccagtgatgtcttttagagctgagcctctgccccagaaaataatgaagcttcagtaagagtccctgaggcagatggcatggagatgttatttgcatccctaattatttggttaataaacaataaactatatttagttactagttagaagattttcattttgtaaatgtacctctgacccttttctttcttaagtgaatgaaacagtaataaataactaaagctgttttttgcacaaaatgctagatagagactaggatttgagaatctatttttaaattcacttattgttacccacttagctaaaagccactatgtgagttaaaggaatatcctgctgtaaacagttccatttaaattcttaacatttctactttgaattgtggatcctctcagccagcttcccgggtccctttgaagcaggcctgtgccaagattccccacctctcatggggaactaagcaagtccattcttattcccagctcatcagaataccctgtccactcactctgctgacccacataagctgattgctccctgatgtgtggagaagtgattgtgataatgttcacaggaggggatgtgctaatgcatgagtgataactggagcccggtaaaacttactgagacagaattctaagcagaattccacactcctttcctagtgtggtccactctgagtgctagagttttaatacaatccaaggatttctccaagataattgttaatgacttaattttatgaggattttatttatgtaaacaatcaaataatttttaagaatgaatgaatatatgtatatatatatatatatatatagagagagagagagagagagagacttgagtaagaatatctgcataaaataaattaagccaagaataaaatctagaataaatacagtaactgctctggagaagtctaattctgctctactggagatacaatgagaaccactaacatgattaaggagatttttttcaattacaattcaatttgccttacataatctctgtcgttcttatatgtatgcagctggacccaagaattttccctcctgtttcagggatgttatttccaggatataattaattaatatattcattttttactttattcttatattcattttgtagatattgagtgcctattatgtccagagaaccatgctaggcagtggttattaaataatgaatacaaataatttcttgacttaaaaacaatgggcaatcctaagagtttacttagtacttgttcagggtttgctacaaattccatgatttaactgattttcttattgatatccattctttgatcttccctctaatagaggggcaatttggtaacctatatcactattgtatgtttgagctttgaagcattttgtagtctatatacttactttctgcatcttcaccgagtaatattccttgtgatctgcgtggacaagaatgtttttacttttttttttttttatatcagagagaataacatcttgagaatgatgacattttctggacaattccagtgaatgggcacttagctagggaagccaagaaattatgcctaattaactatgctatttccaaaattctgcagacttttactaagaatgcatgccagggatgaaaaaatacaaagtaaagcagtagatttgcacccagaaaactgacataacttttcctttctttgcaacattgatatttgccttcaactgatgaaggcttcgatcttgatttcaattagaaatgcagtgaacaaagagattctagggaatacatacaacatgaagctcctcagtcttccttacaggggagaactacacagcagcttccaaatagttgcaaagacgaacatgacttcagtgactttgactagattatattatttttattgcctttatttttcacacataagacttcatttctgtgaataaaatatatgacatatctggttttccatatggtaaaatctttaaagattttttgtacattctctaaatgaataaattggattctcaagtataaaaacatcataaaaattgcttataaaatattctaaaagaaaccctgagtagctggcatatagacgtgctctacaaatatttgctgaatgaatgaaccaggagaggtatttatagtaaataaggaaatgaccagactcattaacaataaaaattatatacagtcaagtgttacttagctgaaataacatggtgtaaataaatggtgtaaataatatgccccctatattaataaaacagatgaagcaaaactgaaaataagccaataagaaataaaatccacttgatagttttgctaatgattgtaacataatagcttgcattttaacttacattttaaataaagaacgcagtccaatctctcaaattatggaagtttttcttctaaaataattctgataactagctttcatttgaatatctccagtagtgaagagctcattacttttatgggaatccattctattgttggtaatagttatcctaatgctttaaaaatattacattgacatctgactacctgcatgttccttttagaaaaagtttaatttagaaaaagaaaaatactactacctgagataacacacaaaggtgtattttctcttggccacagtattttcaggacattaaaaaaataagattatacatcatttatactgtttagtaagtgagctttcaaattacaggtcatgtaagtgttcaagatgttctaatcagacctaattgtcactattttacattaaacttgtatacatgtctaatgtaaaacaatgtgtttaaaataatgtaaaataagggtatgtttgtttttacactctggctcaggctagcctctgtgtatatcactgtggcttctgtgtggagcaagaacttaatcaaatttggatttgcattcacattagtttcaccactatctaggctttacgtagttgtaagcaactgtttagcttttgggtctggctttcatttttcttgtctcttataatcttagggtaatatttgacattttaaaaacaaattaacatccttaaatcaaagatcttaaaatataattgttgtgaaattccctgaaaataatttacatattttttaaatacatgaaactaaatgacttgctgtaagtctgtttctcacaactgacactctgcttttcctgtgaagaaatacataaacagaagcctcagctagacagattttcttttgtttgcctaattgccagaaggttaatgattttcataatgccatttatgtctggatattatcagcactgtaaaaaaaaaagttctaataacttttgttagtgtagtctgcagaaccattgaaggaacaaacatattgtataaggaaactttttgttttctcagcaaagtgtttcaaatatgttaaaatcagctcaatattcagtattattatttggttaaattccagaatggaaagaacttgtagtaaaatgattaggctatgaacagacaaatgcaactgacaatgttaagtcgaaaagtattttttttttacttaattgaagcaaaatattaattttaaaaatatgagttagagctgaataatctgtagacataaaagcacgtatacttttagaatgtgtgatgttattgttgcatcactggaaaaccttacgtgtttattcttttgaagagtggaagatggaatttaatttactctttaactttctgttataaagcttaaccgtctttagtctcttcagagcaatgttacgagattgagtttccacatcattctggttattcttcttgaacacccttagttttaaaattatctttcttaaaagattgatctcataagattgaataccttgtcctatgttttatagcttataatttttcttttgtggactacctgttaaagtcttttacccattttttattaggtttactgattgtttcttattgatttgtggggcttgtttatacattaacaaaaatgaatatttttgttataggtttagaaatatcttctcccaatctatagttagccgtttaactctctgattcctgccttttgataatcgatgtctaattttactataatcgaatttatattttcctgtttagctagtacattttgagtcctgtttaaaaaatctttcccaaccacaaaaagatgctgtatgttctcttccagaaacttttacaatttgatctacacgttttgaccttgatttttgagtatggtgtggggcagaatcacttctagaacaatttattgtgggggaaaaggacggtgatttttgaaaaaggaaacaagaagagcttgtggattgctggcaatgatttctttatagatctgggtggctgttacactgttatgttcattgtgtgataattcctgatactagctatttatatgtttgtaatttgttcatttatatatatatatgtaaagactttataaaaatgcatgaaaaacatatctaataatacattgtaaatataatattctacttagatgtcataattttaaccctgtatattatttcataaagtaaggttacataattctttctaagcattagatacctttaatcatgaaattgataatgcgtttcttcaaaatgagtagctttgtttattgttgatgttaaaacaaactgtactggtataggttcaggtttccagccagtgaaaaacatttacatcattattcagtttgttatcctattaggtttcttttccaggtttatataattggcaaatttcataagcatgtctttcatgccttagagaataaaaatattaaaaatgacagtatacaggatgaaagcctgtggaacatcattagagagcgctcttcaagctgacatcaccattaatcaacgtatttggggcacgataactagccattttttaatctacctaaaactgttatctcccagcccacattttactagtttacatttgccagatattttgtcaaatgctttgcaataattaaaattgaagatacatctatggaatttatgctgttctattaaacaaggactcaattttataaaaggaaatccttataacctaccactattgcctcctctatcaccagaccccattcatctttttcctaaatatttacaactcacatgctagactttaaagaggatctctcttgttatttttcccagatgtaccaacttcactgtttttaaaatttatggtttttatggtttttagtttttgactatctttctttttttggcagctcctttaataaatattcaagaaagctaagattacatttatggataatgccagtccttggggttataatctgaattcgaatgcttcaaaaagttaaaggaacaggccaggcgtggtggctcagcctgtaatctctgcactttgggaagccgaggtgggcggatcatgaggtcgagagatcgagaccagcttagtcaacatggtgaaaccgtgtctctactaaaaatacaaaaattaactgggcatggtggcatgtgcctgtaatcccagctacttgggaggctgaggcaggagaatcgcttgaacccaggaggcggaggttgcagtgagccaggatctcgccactgcactccagcctggcgacagagcaagacgccaaaaaaaaaaaaaaaaaaaaaaaaaaaaagttaaagccactttgtctgtcttattatgtcttagcttgtctgaggaggtatttgtctatactcagttagtagttttgctacttctagaattatttgaaactgttgtctttgttggtagaaatgggtgacaaacagtactattttcctgtcattaaataatatctgatagtattatatcttctttcttctgttttgcttaaaaaatagctttcaagctcttttgtttgaaccttatttatataagtattaatttatcgatattttaggaatgattgggccactgccaattttcctactctagtttataacagatgttgattaatggatatagccctcttccctggctactctaatcaacaaatatctgcacttggttgaagcctgtttatccacttctcatagatcacatgacctccttgcagatgtttatcccccactgcaaataaaatctgagctcattaacgagttcattttagcacttattaagatgcctgttactgtttttgtatcaattagataattctccattataggcttaaactcatgttacatattattttcaatgttcagaaggtcttaaaattcatggtgtcatgtcttttttagttttgaataaaaattagtttttcaaatgtttatattctgtgcattggtcttagtctagaacttctcttagacttaccctagaaacttccaatttatccccaatatcttttaactactgcaaattttaacaggtttactgatgtataattgatatacattaacatatatatttatataaagtataatttatatatagtggtaaattttatatatgtacatattaatatatatcaatatacattatactatgtttagatatttaatctaatatattaatattaacttcaatatatttattatatattatattttatatattataaatttatatgaatatatacactgtataatttataaatatgtacgtgtgtgtgtatatatatatatgtcaacatggaaatattaccttttagctcactaattatttcttttcaggctggagtacagtggtgcaatctcagctcactgcaacctctgcctcctgggttcaagcgattctcctgcctcagcctccctactagctgggattacgggcacccgccaccacgcctggcaaatttttgtatatttttttagtagagatggggttgcaccatgttaggctgatctcgaactcttgacctcaagtgatccacccgcctcggcctcccaaactgctgggattacaggtgtgagctaccatgcccagcttagctcactaattatttcttagattatatataattggtagcctttcctcagatgagtttattttcctatcaaccaacttttgcatttctaaaactacttcatagtttcttttagtatccatctataaatgttttatttttccctgttgtaactgataattactgctatttttaatgaatagcattacctattttatatttttgagaggataaagcctatttatctccactagccctcaattgctattacttatggaactaattggtgttgaacttttgactttgttgacttcgtggcattggatttcattcctgtcatttgaaattttcatttgcatgttcttcttgacagccagtctctctctttctggtctctctttctctttcttctctcttcctatctcctctcatctcccctgttttttgtgctttatcattttgggactttctctactcaagtcccagaatgtccagtctgaaagtgtaccttacattactcgcccgatgcctgtgcctggcagtgtttttagggaatcatgtgtctagtcaccaagccagtgaatgcctttactcagctcagatatgcctatttgctaacctctttgggcatacagcctcatataatccatatgtttaagtgagtaatcagctttcttcagtctcttttcacaaccaggttagccgagggccagtctcggtttgcaaccttaaagcaagctttctgtagctgatacacacagggaacttacattaccaatattccgtagtagtcaaatgcccaaatgcctttgtatgtccccagatccggactctgtctggcctcggcttcagccccactcattgctttgcatgtttgttgcatttcttgtgcatagagatgtttatcttattttttgatcctggctatgtcttttcaattttcttcttatctatcttatctaaaaatacagtgtatttgaagcagaagggggtctcaaagcctgaactcataatgcaattttgcctggagtctccttttcaatttatttttttcagctgatacttatttctcagccagttattaaaggtagttctaaccctaattgaatttttttttcaccttgtatttttgctaaattagaatccaggcatatagtctctggtggtgttaaaaccaccaacttgagtgccgcgtttcttcaggagccatttatcactacaacagaaactccatggcctctctaaaccacccactaaattcctcttttgtctgacttactgaattacaaattacaaagcaaaaataactcatattagtccagagtactagtttcttcaattattcagattctctattgtaatggatcactctaggagcccacatagaatggacacgtagaatacaaacactgtatatctttacagcatacgtgtgctcacaccatatactacacacacgcaaatacacagggggaggaatatctgtgtatgtgtgagaataaagagaagagtgaggaaggaaagacagatggaggatgggaggggtgggaaagggaagagagagcacagaagaagagagagaaggggaatgaagaaacagcattcttattgtttcgagactagcaagagttccataacaagtatacatctttcaagttacttcaacaatacactagttatttgctagatgttttaggcactattatctctaggcaagtgttcttcttaggaactaagagtttatgactgttcagcatctccacttcttctaactcctctttgacgtccaaccactttctttgagctgctacaatacattgggaacttttttgccctcttatataccacattccagaggtggttgtgatgaaagaggtatcattattaatcctcggatcaatagaggttacacatttcacaagccaagtaaacaaagtaataaacttccccgaattgcattgcttgatagaccaaagagaaaaagggaacttttcatcgatctttccaccatgttcctcatgaaagactgacttttgccctccccttgaggttaatcactacagtattctctccacatatatttctgctaagaaatacattttgacttatatttcttctgattttagatttttgctttccttaaagttaacaataaattctattttgctaaaagtaatgagataaatgggattaagcagctgtatgttagttgcttgcttgctgaaagactggaatgcagcaaacaataagtaactgaagaaaatttattctggagcattcattagcaaaacagaggaaatagtctaagtttcaccaatcaatcagacattttctcacctgttacctcattgtattaattgctcgttgacttgagttcactcaatcactctgttgcttttggtaatacatagaactctgtatgaaattggctataaaatttcttcaaggtttcgaactgtatatctaacaggtaagaaaatatatttgttaccccacaataactgagtatattgttgtccccaaaattaacctacagctctttcaaaattttatggaattctaggtaaaataggaagatgaatgatatatgacaataaggaatattatatattaacactacaataggaaaaaaataacatataaaaaacacactacaaagcaggtataagtaactcattgttagtaaacagattatcaggaagtggtcccaagaggtactgcagactagaatctccaggatacacatcctgagatgaaaaatagcatctaggaagttaattaggagtgttttggggatgaaaacctgtggaagagaaaggaatgaaacagaaattagttacagggaggagtttaggtgaaatgcagtttcaatgaagtctttgaccaatccctgcagggagctctgagactgtgaagacacctcagagtttctacaggttggggcagggtactggctttttatagccccaggttgaccagtcgttgcagttgcacaaccccatgaaggtataccatctacatgtgcctctttttaacccaggaaattcctgaagaggaattacagctaagtactgtatcatagaaaaaatattcttgtaaaagtgtgaattatatgataatagaaactgagaagtagttacatcgtttgcacatatattccatagatagcacccatataacctatgcaaacacatacactagatacttaaatttttccaaatgttttgtgagatatgatttcgatatagtgaaaggtacagattttaaatttgtatttttttttaagagattaatcttgggcagggatcaacaaacttcaaccctctgtccagctacaagcttttgttaataacacttcattataacatggccatactcttttgtgtatgtactgctcttcatactataatagaatttggcagttttaacagaggtagtatggtctacaaagccaaaaatacatagtatttaaccttttacagaaaatgtttgctgacccttgatctagggtttgctattttcaagtaataccacctcatatgtaaagttaagaccacagcataacatatttcctgtccagactcctatcctttgtactattgtagttgcatatctgacttccacatttattataaaccctgttattcatcattactgtttgtaagcactaaattatcttttaatgaaatttaaaaacatgaacaaatattttatatgtacttaacatgtttagcattttaagcactcatttcgtcatgtaaatatgagtttcaaaatggtaaacttcccttaaggtgaaaaacttatatttttatagtatacacataaaagtgatgaattctcccagcttttgtcttgaatattacgttatttttatatttaaaatatatttttgctggacatagaatttcaggttgccagctttttttttatctttccttttcatcatgtctgttaggttgtttcattgtcatttggcttgcattatttctgctgagaagttgtaaccctctgaatacctttaagattttctctttagcatcgtctttcagcaaataattataatgtgccttattgtattttcccttgtatatctcctgcctggaattcaataaacttctcacatatctgagtttatatatttcaaccattatttcttcaaacatattttattctgacccaatctctgtcatctctgcttgtagtactccacttgcatgattgttagggcagttatcaatgtctcacaacttactggaataactgtttattttttaagccttgtttttcctctctgagcttaatttagatgccttatatggccctacattctagtacaatgatgttttcttctgtgtctcatctgctgttaagcccatccattaaattttctatttcagatgtaattcttactcctaaaatttccattttgttctcgtttgttgcttttctccttcaacattttgcatttttaaaaaatgtttatatgttttattttagataatagaattaataattactgtttttaaagtcctggtctgctaatttcatcatttctgttattttggggatacatttccattgatttttttctctctggttctaagacatattttcctgcttgtccaaatgtctagtatatttttcagttgatatacttgacattatggatgcaatgttgttcagtttctaaatgtttatgactttccttaatggagtgtcaagttttgttccatcaaaaaattaatttttggtcagatttatctttttcagtaacctttgctcaggtgtgtccagactagccctcatattaggactaaaatatccctacatataatgcatgacttttatgggatgtctactgaatgcctggagggattcaacaaggtctctcaattttgtctagtctgaaatcaaatttttcccagctctgtgcaacctctggttattgttgacttcagaactccctttacctggtcttgtgcagtcttgatctaaaagtgcacagcatggtgtttcttctgagtccagattgcagagacacattcatgactcccttgtagatttctaaagcactttacacagctgtgccctctctgggactctgtcctgttaattccagcttctttagtagctttgaattgtaatatgtttccgtttcaatgacactactgcactgctgaactctgtttgggatcatcttccatatgccatgatccagaaagtgaagctagcagaaagccaggaagttggcagggctcaccttatttgtttatcttattttatggatcacgtactgcactgcccattgtccagtccctaaaacagtgattttttaaaattttattttattttattttttgagatggagtcccactctgtcactcaaactggagtgcaatggcaccatcttggctcactgcaacctctgcctcccaggttcaagcaattctcctgcctcagccttcccagtagctgggattacaggcacctgccaccacgcctggctaatttttgtatttttagaggaaatggggtttcagcatgttggccaggctgatctccaactactgacctcaggtgatccacctgccttggtctcccaaagtgctgggattacaggcgtgagccactgagcccagtcagttattttatatattttttagttttgtaattttaaaaaaagctattctatcatagttttaagcaaaaataggccatgtaaccattattatttgaatatctgtgatgatttatgaaatgattattatgaacgtcctcatagaataaattattttgccagcctttaaattccttatttaaaaaatagtacacacgttttgatatactgtacattggataatctattgaatatttttatatcattctctttagtagctgaactcactgtaaaaattatagtgcctcttagcactaacattatgccatattttctgtaacttattttgtgtacaaccctagttattttaaatattactgtaaattaagaatattgatctatatgagtgccatttttctaacaaatgtttttacattcttactatttgctgagcaattcttatattttgccaaaagagatttaactttgtttagtatctaatttttctagaaatatgacttacaagaggtattgactgtatatcttctaagtgttaaataaacattcttcctgatttcctatatacttccctgtacctctcagtggtacaggaaattaatgtaagattaggttcattttaagaattgcaaatatttttctactttacttcacaagaaaaatatattttagaattgtgtataattgcttgtttttaatttataatttattaaatgataaagtttacatgacagaaaaaattggatagttacatacatttttctcatgattttagctgaagagtttatggtaaattggtcaaccctcagccaattagactttgacatgtactaataagatctaattgaggaattatgaagacatttgctcaggagaaaatgagcacataattacaccataaagaggttaaagaatcaatgttaccagctggaagaatattagttgaagtcccaatggcatctataaaggatatttcataatatatctgtgaaatagagcactgccaagaccaattaagatatgtagaatattccattgtcagttgtacaagttcaaatttaaatattcattttcccatcttacctctgcccatcttcaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggtaagtcattggcaggaaagcaaagacacagaattggattggaaatattagaaaatggtacaggatttactaagcatatatagttatcaatatttatgtattcaaatcattgggaaactatttattcatcattgttgatggaagaaagtttcttcaggctgtaatttctatccaatggttaaagcaatgattctagatctggactatgaatttgaatcacctgaggaagttttaaagcacgtagatgaaaggcaaacccggatcaataagaccagaatcacgtaagttgaaatagtgattaatgatactgataacttttctgaagacagcgatcttcaattgaaggaaaatattgaaattatgaagaatataatttagagaagtaagagcagtgatagatgttaagaaaagaacttgtccattttataatagtgtcttaaacacttattacagatctatgttcactttattcctttattatgaaagaagagaataaagcttaacccatttgttcttaaaatgtctctattaacttaaaaagttgtatatattcaatcaaatattcaccacataataatttgaataaattatttaacagtaaaatttaagtgttctactttgtttaattattttaaaaagcaggcatgaccaaaatcaagtgctgtcatcaatattaaaccagaagaagaagaagaaaaagaagatgaggaggaggaaagggagaggatgaaagggaagggggaaaagaaggaagaggaaagggttcacttttaaaatcatgtccttcacagtattagttggagtgctggatatttttaactttatcatgaatcactcttgtagactttgtattttaaaagtccccaattattttttctaagtaacaagagtttataatttctagctaaagtggatgttcatttctacagcagtatgtgaaataaggatataatgtcctgataataaaaaatgtgtctacttaagtagaactttagaaataactcctttcaagtcataattatatggaaagaatatttgtgtattaggatgtataagttacggaaagcaagtagtgggaaaaatgcctctttctaaaatgtcttcatctcgcaattgagataattcaaatcctcaggcataatttatagaaaagtgcttatcaagcctgaatacacagtagaattagctagagaactttaaaacatatagacccttgtgtcccaaccccagagacttgaatttagttggtctaaggtgcagcctgggctttgggattttaaagctccgatggtgatgctaatgtacagtgaacaccgaatacatagtttagattggttttcagtctacagttaagaaggggatagaggaagtatatgctgaaaatgaagaggagaacagaaaatttgaaagagttgcccttaaaatttggcagagagagagaggggaagacggaggagtaagggggttgggtggggggaaggggagggagaaatcaagtggccaaccaaccaaacagcagaccaaacaactgagagtaaacagtgaaggcttggatcacagacccttctaacacccagagcactcattattttctaactttctatggtttctaaactaagatcaaatgagcatgttggtaaaattgcttgaggggtttactttctgtgatttctaaactaagatcaaattagcatgttggtaaaattacttgaggggttacaagtcagactctgaaatactgttctctatatcagaacagaaatactgttcacatttttgtatttgtaaagtcttcatctcaaaattaagagtgttcaaatctcctctcctctcataatgtgccaagatagtaataaagatagctgctaaaatacttgaactttaatgtatctgtcaaatactgaacagttaaggacggctaaatgcagagacataaggaaaaaaggctaaggaggataaaattgttcagcttgtcttggagtcttttttttttttgagacggaattttgctcttgttgcccaggctggaatgcagtggtgtgatcttggctcactgcaacctccgcctcctggattcaagccattctcctgcctcagcctcccgagtagctgggattgcaggcatccaccaccatgcctggctaatttttttttgtatttttagtagagacagggtttcaccaggttggtcagtctgctcttgaattcctgacctcaggtgatctacttgccttggcctctcaaagtgctgggattccaggcgtgagccactgcacctggccttggactcttgatattacatagaataataatggttgagtcggggagacaaggatgtcatgtagtgaaaacatcacaaattatgaagatatgctgggtctacttatagggctctccatcttaaggtgataaaggtgcatttctattgtcttctccctttctggtgttcactttgtttcttcctttcaaatattgtgtttcttattaaaaatcagtatgctacgtgatgagtgattattagtagtgagctcattataaaattttaaaaatcaaaacaagttggagactatgttagtctgttcttgcactgctgttaagaaatacctgagactgggtaatttacgaagaaaagagttttgattgactcacgtttccacaggctgtataggaagcatggctttggaggcctcaagaaacttactatcatggcagaaggcaaaggggaggcaggcatgtcttacatgccgggagcaggaggaagaaagagacgggggtgtcacatacttttttattttttctgagacggagtctcgctctttcgcccaggctggagtgcagtgacgcgatctcggctcactgcaagctccgcctcccggtttcacgccattctcctgcctcagcctcccaagtagctgggaccacaggcgcccgccaccacgcccggctaattttttgtatttttagtagagacggggtttcaccgagttagccaggatggtctccatctcctgaccttgtgatctgcctgcctcggcctcccaaagtgctgggattacaggcacgagccaccacgcccggcctgtcccacactttttttttttttttttttttttttttttgagacggagtctcgctctgtcgcccaggccggactgcggactgcagtggcgcaatctcggctcactgcaagctccgcttcccaggttcacgccattctcctgcctcagcctccccagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccctgtcccacacttttaaacaaccagatctcctgggatttcactcactgtcaggagatcaacaagcgggaagtccacccccgtgatccaatcacctactatcaggcccctcttccaacactggggattacaatttgacatgagattttggtggggacacagacccaaaccatatcagagacacaatctaaatattgcaaaatatatttaagtaccagtaagcctgccacataatgattacattatttaataatctgtgacagaaatgttttaatccttactaatacaaaaaaaaaaaaaaaagagtccaatcctttgacgtattctaaaagagttaaagttcgttgacttctaaaaattcttgaatattttagggctacgtcttatcattcattaagtgattaaaatttagcatttacaaatttcaaaaaaaagtactcttggggattaagtttattaaaaatgatattaaatactagagttttttaatccactactgcttaacattatgtatactggacttgaagagaattctgatatagagaagattggatggctttttgatggaaaacaccttacaagatgtaaaaatttatgtatttttgaaattgtttttactatccattttataatgattgtttacctgagaaatatagaagataatgtatattgaatcacatgaatataattttaaacaaatgtccatggttatgtttttctgattgttggggaaatggacaacataagtaattttttatagtattcttattaaatgttcatatggacattccgagttattttatcactgttggataatatattaaaataagcaaagaacaagtcatatataagcaaattatgacagtttcacaaggttttagagtcatgaatcttgcattagggagtgagaatggctcctgaaaagattcctaaagaatggtttatctgaatatttaatattcaaagatctgagtttctaaatgggcttaactagtcaaaccttccattcctctttgatgatactgagcataatagaattctttatattttacaatataatttccttctatttagaacctcttttccaatgtaataggtaaataaaattgcccaaaaaatcattacatctacatactccaccaactctaatttgcatgattatcttgagatgttttcaagtttcctaagtataatctgttagagagagagagaggaagtattctgtataagcattttgtatcagaagtccattaaacattatattaaataagaattccagcaggcttttgctaagaggcctgttttgcttgggaaattcaattactggattttgaatgcagatattcggagccaaaataggaaactggagtaaaagcagtggatgccttctttacacaccactattattttgtaggataggaacatactacaaatttaccagtcatatgagcgcagtttttgtttttctttaaaaaacacttcctaatcatgaaaacatgcttgtatattctcagttatttttaaaaacagttttgatccattttgttaattttaagtaggtgttagactgaaatttgttaccactgcatctattaaatggagaattctacagaacacagctgttttatcatatttaaattatatggttagatacttatcaagaatatagggataaacaaattcatattatctaagaagtattaaatagattacttattttcaaaacctagatctccttgtcacatatacgcttttcccatgtacaaatgcatacacataattgtttcaataaatttaaaacatttcaaaaatctagaagacaaatacaatagttggcagtttcatttatgaaacatttggattttctgaatagcaaggcataagctggaccacgtattccctactttctttttaattacatattccatcaaccagtatttataaaataaaagttctcaaaaacatccttttgagttagcctgtaattagccatcaggcaagtgaaagccaagatatggagtcgaaaggtctgaattcatgtatcttgtttcatttgtttgttttataaacttggagatctgactttatttctctgttcctgaaatcctaatctgagaagtagatataattcctattgggatatttaagtgagattatgtaagtaaagaaatttttcaagctattaagattagaaacatgtgtgtcatcaattcccaattttagaagcattctccaaatctagtgtagtatgttttttcagtgacaatagtcagtaatgacaattttcagaatttttagtcaccctctatgtttttcagattccctttacctctttttactcttattcatgattgaaaatatctgacaatattttagattaaggaaatgttacttaaagttggaggtagaatgtatgcaaatctctgtcataattttcgattaacacatggtaaatacatgtttagatagtgcagtgcaggctgggtcagtgaggcatgacaggtagacctagctctgtgccaggtgccattgcagtgcttgtaacaaattatctgttaccatcatgatggccttgtgtccaatgagccatttaaggggacactgtttagaaatgaatggattgttctgtcctttcttttcagccatttgttatagtggttgcactaattttccaaatcacttaaaaatctgttcccagtataaatataaaatataaatgccattctgttacagttcaatggtgtacttagattctttcaaaatatctagaattttgtctgcatgcgaaagtcaggatgacaaccatcctgtcgcctgcccctacatcttccatcggataataacttctacttcacttaggacatgaatgtgattcttttccccaaaagatgagtattacccttgcttctttatgtaaacatctacattcctgctgccatcagttatttgggtaaaggatcaggcagacatattcataataattttatagatagcttattgagaaataaaacacatcagaataatctgcatcaaacaaacactttctaaaattatctttgatataaatggggtaaaaatcttcagaacttgtatagaaaaaaaaacaatttccaaggcgatttcagaataagctccttatttctgtgaaatagatttttctgtttatactcctcttaggctggataatatttttaaagtctcatgaattttaataagttgagtggatattccagatccttttgcatatactgtaatgcatctactagtgaattttgatcacctttctaaatacacatttgtatggtgagattctcattttcaaaggtcatgaggtttcttgggacaatttctgagactcaatattgtacataaatagaactgttctaacaaatatggttatgtgtttaatatttttctaaaatttggaagataaaaataagatgctgttgataatattgaatatattattggcatatattatgagataaaggaaaatgttataatctcataagatttcttacaggctgtaaaataacagtatatagttcttcacagtataatgtatttttcatctatgagataaaataggatatatgtaattattcttctaatgtttaaagtatccatgaaacaagatttgttatcaattatactaatattttcaggtgttttattttacattgaactcaatgctaattttttttacgttgaactcaatgctaattttttttacattgaactcaatgctaattttttttatcgtgtcaaggttggatttaggttacctgaggctaaataactccaagtaaatacatagttatataatgtgttgataaatgggtacctacaaataatttgaataagatatcagttccttcttttaagatgtatgtttctactctgctcaagtggtaacttagaggaatactagtatgcttattttgggaaatttagggcacagtaaatcatgcttcttatgtgcctggagacgcctgagaggccgtggaatgagtaattctatgttacactctggaatcagaccacctaggcagattatacaattttggtaacatagatctgtgtatcttcacgcagattctttaagctttctgtgcctaaagttcccaacctgtaaaatgggtctagtcacttacctgaatagtatttacctcaatggaggttgtaggtattaagagaaaaagtcaaacaaagggtttagagcaatgtctggaacatattaatcactcaattattttatacatttgtgatttctaggtgcattaacatagtatattggctcttttcttgaaaatttaaaatagcctgttacttccactttataataacgtttttctattagtgtattggtgtgtgtactgtattacatacatctgtgtttcccagcctggaatgacaaatgactcatttggaagtataattgagaatgctaatttatgccattcaaatcttgggcctacttattatcacatcgagtcctatgccttgtcatatgaattgtgcctggaaagttttttcagatatatattttttaatgaaacttcagtgaaaatatgactaggatgttttcattagacttagtttaataaattcacttgataaagtgcgttaacttcggaaagaaataacccatttttgtctacagtacttctctgtgtcttcttaggccaactgaaaagggtaggataagaagacttgaaaataggcttataagtattaactaaaacagtttatgctggttagccatgaaaggacaaatcagctgcaccaggaacatccaggagcttgtcagagatgtagaatctcagaggcttaacccagatctactgatcagaatctacagtttaggaagactcacaagtgattcatatatacctccaagatagagtgtgttgcttttgatatttgaagaactctcacgagaaagaggaataagcatcagcatttgtgtttccaaaccagaaggtagaattagaataactggaatttacagtgcaaattgcagacagatttatcgtgaaaaaagagtgagctttgataaataggcactcactgagcacctactacttattgaggctagggataaacagaccaaaacacaagcataattgctgtcttctaggggtcaataaactggtgataaggctaaacatatacaattataagtatattgtatgactgttcaaatagagaggtgcttgcctaggttgttttgggaacactaggaaagtggtcttattcagagtggttgggtccagcaaaggcttctttggagctacctactattggctaaataggtaaggagttggtcactcagagaagaggggcaggaagtcattccaagcagatgaatcttctgctgaaataggtaggaatggagagtgggattctataaataactgcgtttttcctgactttctgacatgcaacaaaataaaaagctgacctttatctatttatttagagacagaatctcgctctgttgcccaggcttgagtgcagtagagcgatttcagctcattgcaacctctgcctcccaagttcaagggattctcctgcttcagcctctcgagtagctgggataacaggcatgcaccaccatcccatgctaatgattgtatttttagtagagacgtagagacggggtttcgccatgttggccaggctggccttgaactcctggcctcaagtgatacacccacctaggcctcccaaagtgctgggattataggggtgagccactgcacccagcaaaaagctgactttttaaaataaaaaaaactctgaaattatatcctgtgaatcagtaatgcttaatttatataatgtaaatatctaattttggaagaaccttggagtttatgcagtcgcctagggcacatttttatctctgtgccattcatcatatagagctcactgcagagcacaaaacagatgtttatgagtttacaactgaactgaagtatctcattctgtagatgaataagctgaggctgagaaccatgatgtcccttaaactggaaccttgaatccaggtatactgacctcactactgaatatggagccaaatacttattttggttcagcaagaagttccattactataatgaacccctgctcattttgagtaattgaaaatactattgaatacatacacgatatttatagaacaagatagcatgggctctggaccggacctcaaatatctgaactctgctccaacactttctcgtggtgtgtatttaactatgttaatcaacctactatgggtcttagttgccttaggtgtaaaagcgatataattgtatttaccttatgcgatttttgtgagaaataaattaatcaaaaataaattgtttagaacaatgccccataaatatagtctcttcttatcgtcctcttgtttcactttctcctatttatcagtattattacgaatgctatcattaatgtttctcaaatactatattcaaagtgatataaagaatgcaagtaagtagttaatagtaggtctagccttgagaataatatattttaattggaaggacagcaaaaatcactacaataactttaaacaaaagcccgggtcatcttgcacagctttcaggatgcttatgcccctggacaccgtgaagatacccattctatgtgtttcacttatgcatactgttttccaggtagctaatttagtcagtgttgactttgggagagaactactagaatgttaaaatgtcttggcaaataaatttggtttgcttgagttaaatagcttaattataggctgcagtgaaatgatcattctggcaaaaagatatagtgctgacaggctgtctgaaaggttcattcaccatctatgccttttcagaagtctagagcaagagtagagaatagactttggcttctagaaaaaattctgtccatttccaaatgaaaataatgtttgagataagtatctgcatttctccgatgaacttcaccaatatattttgatgagacagtgaatgggcctattgtaattgcaatttaaatgctttataatgatattaatatgcagcttggaagatgtctgtgaaaactcctgtgatttagcagagaaattcagaaaacttcagctgcacaaattaataaataataacagccaaccaacacttattgggggttccttaagtgtttaatgtgctttatatcatttaatcttaaaaacaactaatatgtgaggatatagattattatttttatgattaagccctatttttggctgcagaaattgaggattagagaaagtacaactttccctggggtacacggtgggactgggtaatggatgtgttaactaacttattatggtaatcatttcacaatatatctctgtatgaaagcaaaaaaaaattgtaatggttgaataaatatcacatttcctgttttaaggaacatacccgcaaaataaaatacaaataaaaataaaaaaaactaaactaaactaatcaaacagtggagctaggataggaaaccaaagctacctaactaaccagcctgtgttccttgccactatggccctggtcagccattcctttcacaggcaatgtgaaacttagtgatctctgcatttaaactgtaatatagcgcttgtatataagatgttggtattttatttattttttatttttatttttttgaaacagagtctcgctctgtcacccaggctggagtgcagtttcccaatctctgctcactgcaacctccgcctcccaagttcaagcgattctcctgcttcagcctcctgagtagcttggattacaggcacctgccaccacacccggctaatttttgtatgtttaatagaggtcgggttttgccatattggctaggctggtctcgaactcctgacctctggtgattcactagcctcggcctcccagagtgctggaattacaggcatgagccacggcacctgggcttttttctaattttcaatacaaaaattgaggttcaggatcttacctaaggtcacagagcttaaaagttagaagatcttggtctttaatgctattgttggtgttgctgttttcaatttttaaagaaagtactatttacctactgtattagtttgctagggctgccatcataaagtaccataaactgggtggctcaaacaacagaaatttactctctcacagttctggaggccagaagtccaatattgaggggttggcagggttgactcctcctctgagggaggtgagggaacagcctgctccaggactctctccttggctcgcaggtggttatcttctccctgtgttgctttatatcatctttcttctgtgtgtgtgtgtgtgtgtgtgtgtgtgtgtgtgtgtgtgtgtgtgtgtgttttgatggtattgctctgtcacccaggctagagtgcagtgatgtgatcatagcttactgcaaggtccaactcctgaacccatggatcctctgtctcagccttctgagtagctgggactacaggtgcatgtcaccatgcccagataattttaatttatttattttttgtagtgatgggtctcactttgttgtccaggtgggtcttgaactcctgagctcaagcagtcctcccacctcggcctcccaaagtgttaggattgtaggcatgagtcactgtggctggccttgtttttcattttatatggcattcattttacaaaaaatttatttgtttagaatccactttactctggtatgacctcatattaactatacatgtaaagaccctgtttccaaatatggtaacattctgagacattgggggttggaacatgaacatatgaattttggggggacaaaattaaattcataacaactagtaggcaagtactttataaagttatgacattaaaagttatttgctattgctagggtgttgataggggtgtgtctggtaagtaagaataaggatgatcttgtaagaaagacaatatcttctaggaagagttgtgcatcaaccttcattaactcagaaaatatgcttgaatcaaacgactacttatatatgactctctgcaatcatttatttacattcaaaactccaaggaaacattttcagaattattctatcctagatagcaaatgaaccaaagacactttaagaatcaatctcccaccccgtccccaaagaaatgtttggccttaaaaatcatgtcctactttcaaactccatacagtagtttattctgcactaggcaccatttaacactatcaacatcatgtaattctttgagatatagtaattatttattaaaaactggattccagcaaacatgcattctaaacaatgatggataatttttctatcagcaaagaaaagagctcgcccagagccaaaacagctttccccaattaaaagttgaggttgaattgctaatttcatttggattatactagtatctgcttgaaaatggcaggtttcattagttctcccagtattcttcagagaaggttaagaaacacattccctccacttcagatatgaaaactgagttgcccagggtgaagtcgttgtttatcttatgcacttagcaagcacaattgttcattctatacgcacagtgactgtctcgtttgtgtatttttcagctttgttacagtatacaaattggaaaacagagctgtgtatgacagcctagagcaagagaaaaagactgtgaatttatcataaagtcattcaggctctttacattcagcctggaacaaacaagtatttgataaaagaaaccagaccaatacaaaagaaacgtccagtccctttggaaagattttgtgattatgacatagcaggaatatccaatgagtttttcacatgatatgttaaataaaaaggtatgattacatatctttaatatgacagcattttcttgaaatattaatagaagtattgcactttagctttacttaatgtaagcaggaatgccaatgatgttggtttcaaattttaaaatcaaaaccaaaatatgattattcaggtatattttatgttaggatttgggataactgattgtgaaataagacacaggcacatgtacacacacactctctcaactcttactacacactaactattaatctccccccaaataatatcaaacctatggatatttaatggaatttaacctatttcttagcttattcaattgaagtgcagagatgtttggcatttttactaaaatcaaatatcattgccaatagtaatcaccatgcactgagtacttacctggtaagcactttttgtgtcaattactgtaacaagatcctgagaggtaagagaccaggctttttccttggctttatgtcccactagtctttgctttctctattataccatatttaagaagatatcatagtttttgattataggtgagttgtctgaggggtttattttgtcctgttaaatgctgggtctcatcagctaggaaagtgccttgactattgaatgtatttagtaagtacttgttaacagatccaccaaattgtggaatttagtgaacattggaatatgcagctataattaggtttacaatttataaacaataatgtttattatcttaatttatacttaataatattgagaaatactgcatgtacctacatctattagaagtcaaactgtccaaaatggcatgtgtgggaacacatgaaaagcctaggatttctataggagagaaaacaacagagtttgcagcaacagggagatgagaaggaggctgggaatactgactgtagcagcaaagcttatcctcccttcagacctggaggcagcttgatgctgctgagtgtaatggcaaggaactggtgccaaaggcatggatgtgtggcaatctccaatccaagctggaccagggtccatgtggttagtaatctagatggtggtttcctctgttgaagggtcatggctagaagaggatacaaagaaattttagaagtgttgataattctttgtttcttgacttaagtgcttcttacacttgtgcaaatgcatcaagctgtatgtttatgtgtgcttttttcctatgtgtattaaaattcagtgacaagttgtaaaaacaaattaatcagacttggaatcaaggtacacctctgatggaagaggaatgaaagaaaccaggaactgttattggaatagctctctagtaccaaagataattgtgggagaaaaccagtgggccaggtgaaatggtaaccagagagcttagcaaagggtctttaagagcctacttgcaacatatagggacattatgttactctttatgtaaattcagcatgatataagtacacgggatctactcacacttagtacatagatacttagtatagcacatagtattatttgctgatgaagagggtatttctaaagaaatatgtttggatgtcattgcctctggtttgaaaagaaatgaatgtatatgaaacaggcatcattgtgtgcagttggcatgcacagggaatgacaggtaaaccaagctgtggctactcctacttgcttttgattttgtgtttgttagtattatttttgttgttgttgttctatttgcaggatgaatgcctaaatttattaatcttatttttgtattataattgccatctatgtataattgatgctaacagagaaaatttccatgtctataatatctaccaattaaaattgagaaaatatagaaacaggcaaaaacatgaaaaggaaactcaaacaaaatatataaaattgtgtttacatgcatacaaatgtaaaatgaaaagagaaatacaaattaatcctctatggggatactatatctcaccaatcaggttggcaaagaccgaaaaggttgtttatacactcttttgggaagaatctggggaaacagcattctcatatactcctgatgagcatgtccaatagaacaatagctatagagggggattggcaatacccagcagaactaaaaatgcatttattcttcaacccaactatctcaatactaggaatttagtctaattatacagctccaataacataaaaagtcatacgcacaaagttatttcttgccattgtatttgtaattacaaaatattggaaactatctttatgatcaaatatagattggttgaataaactaggctacatatttgaaatagatacacagcagctgtgaagaaaaccgataaaatataagttgacatggggtggatttgctggatatattgtttagtgaaaaaaagaaaagtacaaagagcgtttattgtatgttaacttttgtttaagaaagaagaaatgaggaaacgtatatatggttgaagcatttctgaacatatttaaatgtactgtaaattgagcaaatgagtgatatgtcaattgtgttgggggccaaggttctcaccatgaaggaaataagaaacatacgtggaatgagagaagacaagaatgaagcctacttaaaaatatatgtgtgtgttaatgagtatatatatatatatatatatatatatatatatatatatatatatacacacttacatactacatgctaagtagctctgacagctggatggatctagaaacaaaaatattgcagtaacactaagcacacctaagatagactttaattattaatacaattatcatctaaaagaaatcagatctagttagaaaaattttaccaggttgtggtcgagaaagaaacttgttaaattaaacacaccttgttataccagaaagaaaggaaaaatgatggttaatacaaaattacataagagccaacttgaaataattcatattggtcaaacctggacaatttgaacaccaaaatagttaaggacagtaatgcattgcacacctttagagaaaaatagaaatgcttaagtctatagagatgataggtaggtaggtagacagacagatagatagatgatagatatagatagatagatagatagatagatagatagatagatacatacatacatacatacatacatacatacatacatacatacataggcaggcaatagatagataaaatgaggcagaagagaggcctcttgcttatagtagaatacgaacttctgactaggaaacgtggaagggtgctggaggtgggaactcaagtcatcatttgcaaccatcatagtaaatactagttctggcataagacattaatggtaataaaagtagaggatacggagagttttgatggggagaagtaaatttgtatagtcttaaagtgtctcttacaaatcacttattagttgcaagggaaatgaataatatttacacaagagaaattaaacatcttgagtgggtaatcaaaataaaaattacagatgagaagcagacactgtgcgcctccagaggcagtggactgagaaggacccaacaccgtgcatgtagtgtcccatgaagaatgtaagtggatgtaaacattatgagaaaacaaaagtcaaaccaaaattgaagaatattctatgaggaatgttctactaaaaagataaaggagaatacattgtctatgtatcagtgtgataagagacactaaaaggctaaggagttattctaggtaaaagaaaattaaagggacatgatacctacctgtaatacgtgatcctagcctggatcctgtcttggataagaaaagatgccctaaagacataattgggtcaatggataatattgggatatggaaggtttattcgatgtagcaatgttaaatttcctgaaattgataactatatacttacctacatatgtccttatttgtatgaaatgtacactatttggaagtaagtgaacatgatatgcaacttattctcacatggttcagaaaaaataatgtgtgtgttggggtggtggaaaaaggagagagaaggagagggagagagagagagagagagaatgataaaccacatagcacagagtaaaatagaagaataagaataaagagtaaaaggacaagtgttccttatactattattgcagcttttccataattttgaaattatttcaaaagaaaagttaaacagatttaatatttccctgaaaatccagcattagaaacacattaccacagcttgtattcgtttgtttgttttaacagggtattctttcaaaaccagattgccttatgtgagtatataaataaacatactaatcttaaaccactaattgaaatctgtattagtatatttaattggatctttccattaactagctaataagtggtgttctccagaaaatagagatttgacttgataaggcagaggaaaaagaagttagaccaagagaacgactgagaaacaatgggaggggcaatgagggacgagagagcctccatcccgtgtgggtgtctgaattgacaggagcacgtggaatataagaaaaaagacacaccaatctatcaatagacagtgttatctaggactattcctgatgtaagtgatgagtagtcagctgctgttttgtgtttggttctatatcatatgttcaaagatactaccaaagatgtacacatagaacactaaactgtggaatcatatttgtttcacaggatttgtaaggtgaagggggtgataagaatttcctgaaagtcaataaaactgtgaatatgctttcaggcatggagaactcaaaagcaccaacaagtcacacttatcagaataagtttgaaagtggaaagaaagaagacgtgacattagcttaggacaattggatatttcaaaacatatgtaggaaaaggtgctaagggccttgacagaaggaaataaatcacaattagatcttgttctggaaaaatctgctaagatctacggtggcaactcaagtctgaggaggacatgaaggttttctcttgccagaggagtacttagtgttccttggagagagttgtcaggcaaatatgatatacagattctctgcactcatttgttctgtgaagatatcaaaaagaacctgcctaaatgagaaagagatttttatctagtggaatgggcttgcactaaatgttgtctagtttccctgccaacactgacattcttgcattcatcctaaggtaaactgttttaaaaagtttgcaccaggcttcgtggctcatgcctgtaatcccagtactttgggaggccaaggcgagaggatcacttgagcccaggagtttgagaccagtctaggcaacatggcaaaaccgtgtttctacaaataatgcaaaaattagccagacatggtggcatatgcctgtagttccagctcctcatgaggctgagatgggaggatcacctgagtccaggaggtcgaggctgcagtcagccatgatcacaccattgcactccagcctggggcaacagagtgagatcctgtctcaaaaaattaatcaattaatgaactataaaatttagctaccccatatgtaatatcagttgctgaaaggtagtcatatttataaatcacatttcatttttttgcatttttattataatgtaagcttattatttaatattcttctcctttagatataatttgtcctacatcatttatttgaagtaatgttgtacatgtcagcataaatgcctttctttcatccttaatacattcagaataccagggagaatctggcattggagaaatgataatgtaagggttttacatgacacatcaggaaattcccaaactttcataagaaaggcccaagtgctgacactatatgttgactcaggtcctataaatgaaatcttaataaagcaattgagattgagaataaaggtaaaattttgaggcaatataggcaataacattagaatttcagggttacttcagcagagattagaaaatgtgtttcaatttcctcaacagagaacaagtcaaatcttaaaagaagagcagagtcaacttttattttaaagagcatcactaaactgattaatggcacttaaatgtgtctgttgacagaacaccagtaacagtattatgcattagcccctatagttattgaaggagctgcatattttttaaaattccagctattaaagtcaaattataatccttgttgggtgcagtggctcacacctgtagtcccagcactttgggaggccaaggcggttggatcacctgaggccgggagttcaagaccagcctgatcaacctggagaaaccctgtctctcctaaaaatacaaaattagccaggctgtggtggtgcatgcctgtaatcccagctacttgggaggctgagcctggagaatcgcttgaacgcaggaggcagaagttgcagtgggccaagatcgcacaccgttgcactccagcctgggaaagaggagtgaaattccgtctcaaaaaaaaaaaatatatataatcctaactctgagtctgagacctaccctgactctaagcttaattccacctccaacccaactcaattgaaaacaaaaatacaggaaccacaaatcataagtgattgaagaagagaaaaatattgcacgtggtatctcagtgagtaaatagaaggaaagagaaccaaagatagagtaaaaggaaatgtctaaattcagctgccgggctaggaaaatatgaaagagaaaaatttaaagaaaaccaatgtggtcagcagtaagaggaaacctagagtgggggaggaagaggatcaattgctttaagaacaagagacttgagattacctttagaggtgggttcagctcaaaatgtgaaacaagattttaaatagagtggtaaaaacagaatgacataaatacaaaaatgtggtaagacttttatttaacaaatatttatcaagtttatttttattgttcagatgttacaatgagtaatggatatatatagactccaccatcatgaccctcatggagattagagctagatagaatataaaggtgtgattatgcagtatgtttttaaaaagtggttgagggtggtgagacagagggagagaactaaggcagtggtagacaagaagcttgcacaccagggaggttgctttcttttttatcttttataggccaggcaaaagtggaacatgtctgtaggtaagaggaacagtgaatgcaaagtctctgagggtggcagggtgtgtggcctggagctgagaggacaaaggcatttccattgacagagatcctgctatgtggcaggcagtgtgccaaataccatttggttttatgaaagttctagaacagcccctgcagttcaataagtacacaaactagatagggacatatttatctgaaagaaaaatggatcatattgatctactcatccctatgaagactgaaaagaggatagtctattgtggaaaaattattttaaaaattaatgttagtttaaaatgtattgtcttaacctaaagaaagcatctacattcatttaaagtatttatcaaatgattgaaaaaaaatttcttggaacagaaaaaaaaaacgcattattgacattctggttttatgggtccaagctgttaaaatatgtataccagggtcttaaggatagaatgagccctagaataataataacctcctttggattaagataattaataaccatgatgtctatttgtttgtctgcttttgtaccccttcttcctactggatgccagctctcatatttatcactgatagaacacaaatggtaaaattataggctagaatttttttcttgttgtttgcttcttttcacattatatggatttccgttttaatttattttcttttttctttgtttgtttggttttttgttttttgagaccaagcctcatcctatttcccaggctggagtgcagtggtgtgatctcgtttcactgcaacctccgcctcccgggttcaagcgattctcctgcctcagcctcctgagtggctgagattacaggctcatgcccagctaatttttgtatttttagtagagacagagtttcaccatgttgtccaggctggtcttgaattcctgacctcaggagatccacctgcctcggcctcccaaagtgctgggactataggcatgagtgtttttccttaccctttcattttcttgaacacattttaaaatttttaaaaatttacaattacaatgaactgatgtttaggtgctcaacaattttgtacagttgtcttatttaataaaatcgatagaaaacttttagtgaagaataaagtattatactaatgcatcataatttctattaatctgacacttagagattgtgaatccaattcacaatccaagtgtacattgctgacacttggagattgtgaatccatctcttagcagggggtaaccataaaattcccctcctaatttaaaaactatcattataaaaaatcagcattcagtgagataggtctacaaacataaactgcttctcagtatcctacaggcctgattttcttcatcagccttgtcagggttgtgttacatcgcttcatctgactacatgaatggctaaagaaaaaataattatatgtaatttgctggattttggagccatggcgccttataaatatttaaaagatatcgtatttagcaatctgaacagagatgtatactgataatgcttgagaccttggcaactcaattaacctctgggcattggatttggaatggagggattattattcattggcaattgtataaccactgtaattaaaaagcacttgccaaccttttaattattaatcctgtggttcatcctcttgtataaaggctaacatgcccattttaccagttagtggattggggaaaatgaagggaaaatgatagatgcaggcgcggtcgatggcaatgttaagactttagaatgcaggactttttccacctgccagttcgttattcattctgattagaatcatttattctatcttaattaattctgtattttgagggttaaagtacttagcgtttgatatattgaattaattctttacttaaatctcatgttgcattccaaatacgttcaattttgtaacataaaaagagctgtagcatttggacctttcttaatgacaacaaaaacgaaaaaagtgtagttttggcaacttttggatcataacatgctatttcctgaataaatagtgataaatcacttcttacacttccttgttaaaaaaagaaaaagaaagagactcaaatgtccatcctatgacatctgggcacaaaaaaacaaaaaacaaacaaaaaaaacgctaatgacactcaatgcaaaatattcagcctccttctgaatgagaactaatctttatgcatactatttgaatgtgtaccctgggggaaaggcataatgttacttggctgtctatcaaagatatcacagacaactctcaaaggttagagcagatgcttttaatcagatgctgttttcattttttatctgagttttcttaaactaaacttggctaggaattcaaaattctgtgaaacatacatatgcactcatatttttgcacttgtgtgcagccagacacataaacatcgccctgtctgtatggttctttatggtacagtgttatagcagccactccagggtgtaatgtggtcattctggttcccccagttattaaaagtgttttgaacagattcagtaataaaccagtgttatagtcacttttgtgcttgagtcaaccttcatgcatatagatttccacttaatggcaattgtattggatttatatgttcttacagtgacctcagatacagaaataatgagtgatcttattaatttgggacctgtctaatgtgggttttgaaaaataatgatttgataacttaaaaactcctttagatcagtaattatgtcaaagtatagaatgaagagtgaacctgtatttaaagaagtgacaaaaaatttttcatatttaagtctttaaatgtatctcccaatagtaggcatttatgactgtactgaaaagtttaatgttttctcaaagaagtaaatagcataagaaaatagttttaaaaaggagctttattatagtattaactaattgtttgtttataagccttatctgcttcaacataatcatgctaccaagaactttattcaattgagatgaagagttatcaatagctgataattatccaagataagaggtatgtctttcatatgactctatgctttaattataacattagtcaaatgtccacatggtatttccacagttaacttgtaaaatgagaatagccttgattcaaaataactaattaaatacagaatgtgattcaataaaagtcactgattgggtaattaagagaagaattagaagacttgaatgaaaatatataatacttgtaatcctaattagtactatgctatttgcttccccttccattactagacatttaccaaccaagtatttaaccttgaaagaatcaaagaagcttttctgagctcatactagttcccaaatagaagctaggctatttaagatttctaaagattgaagataaaatacttgctagcatgtccttgaaatggaattatggacaaaaagtgttagttgctattatataatgaaaacacaaatataaggagtaaatccaccttaagcaaaatgtctaaatgcttagctgtatttatcaagtgcttttcaatattttttcttcctccttttctgccctctttgctattgatagaggttgttgttaaaggtatagttgttttcttcttcagttttatttttagaattaaaatgctctaagtaaccttttttggtggccattatttgacattttaaaatatgtacctttctatatgtataatatcattcagtgttttattcttctctttaataatgtagagcattagcatatttaccaagacataaaaattacaaaagaataaaattagagatctatatttataatgaatatagacacaaaaattaattagaaaagtaaatccaataatttttatataaagacaataccttatgaataagtggtatttatcccaggaaagtaagtttggttcaatattttaaaaaatcagtaatgcaaatcatcatgattatggcaacagatataaaaaaatcatttgactaaatctgacattcataaaatgacaaagtgttcttaacaaaaatggactggaaggcaactacctcaaattcataatggtcaactataaaaactcacagctgatggatgcagcacttaatgttaaacaatagaatattattgatttttgaatgagaaaaagatatgtttttacattttatttaatattacattggagattctagccaatgcagtaagaaaagaataaacagaagcataaagattggaatagaagaagtaggcctgtctgtgttcatagatgacataataatttatttaggaaatcctaatcaatcttaaaaacaaaactactgaaagtagtcaggctgggcgcggtggctcaagcctgtaatctcagtgctttgggaggctgaagtgggaagatcacttgagaccagccttggcaacataataagacctttcctctaccaaacaaagcaaaacaaaacaaaacagaacctgcagggtggcaggctcctgtggtcccagctcaagtggtcccagctcaagaggctgaggtaggaagctcatttgctcccaggagttcaaggttgcagtgaggtatgatcttaccaccacactccagtctgagtgacagagtctatctaaaaaaaaaaaaaaaaaaaaaagtataaatttaacaaggcaacaggttataagattaatacaaaaaattctatatgctagcatcaaatattcggaaaatgtaatttgtaaaaggaataccatttaaaataggaccaaagacttgaaatactaacagttaattataataaaaattatactgacattctttactgtaattaaaaatactctgtaagaaactaaataatagctaacacaatggagagatacataaggcttattaattgtaaaatatgttaacttgttcactatcttcaaattgagtaggtttttaaatttacaaggtgattcaaagtttacttgtactgcaaaaggcctaaaataatccaaactgggtttgaaaaaaattggaggaaatacaagaatttcaaaaattactataaacttataataaagatagtcttgtatagctgtaaatataaatatatagatgaagagtccaaaattgagtccacaaatagactcacatatatatggagaattaaattttaataaagccaccaatatgattaaatgcagaagagaatagtcttttcaacaaatggtgttagaaaatgatatccatatggagaaaatgaacactgctgcttcacattctacacaaaaatggatcatgtacctaaatgtaggcaccactagttttaaacctctagaagaatataaaggagaaaatattcagccttgggataatcagccatttattaggacaaaaaagtattagccataaaaatgataaaagcataacacagagaaatcaaaatcttctattcttcaaatgacacactaagaaaatgaaaatcaaaccacatgctgggaaaattcattcacaatacacaaatacagtaaaagccttgtatacagaaacacaatgacccgttttccttgaaaaggaatccttgtactagtcatactattgtctttgcgtctgcttctcagaagatctaaatgaatacattcttcttctatttcttatcacatatattattctcagaagatccacccatttctgttattattcagaggtgccatccaaacataataacaaaatgttttacctactgaattcagtgctatttgctgtatcattccaatgttccccccgacagtttctcatctgcctgttttactttttgaaacattgggatccaggcttcaggttgatgtatctaaagtacatatacacatgcacggaaagtccaagataaaagaaatattatcaataggaaatgaaaattccaaacctttaatattaggtaattccatataagcctttataataaaatatttatctcattgttttccaaaataatttttatttacattattttttacatttcagtacatggtaaagtttagaagatttgatatttgagaaagggtaaacagtctttagctcctgcatattaataatttatttaaccactgacactaaatatgatgtgccaaataagaaaacaattagcaataatattaacattcccactgttttctcatggttaaaaataaaaagttgtgctttatttctaatttgtgatggaaaggtatgtccatgacttcacatatgattgtacctgcataacacatttggctggcacggcaagtgggagctgaaatcctttttttcaccatgtttcactatgtcaaatttaacttttgacaatttaattggaagaaatccatgtactttcttaaatatgtcttgaatattcagggaacattatttgtaatagagcagagttggaaacatttgtctatcagtacaatatttctgcaatcaattacagtatactcacatgatggaaaacaatgtacctgataaaagtaaacaagatagatgtataatataccacggtagaaacataacttcgatagggtctttcttctaaaacattgtaatatcatatatattacatatcattttataaacatagattatttttatatgtagatgcatataacaacctagaaggatatatggaaatctcttttttaatcttttactttaggtttggtgggtacatgtggaggcttgttacataggtaaacacgtgtcacaggggtttgctgtaaatatttgatttcatcacccaggtattaaacccagtgcccaatagttatcttttctattcttctccctcttccaaacttctgtcctcgagaagaacccagtgtctgttgtttccttccttgtgttcataagttcttatcattaggctcccatttctaagtaggaacatgtggtatttggttttctgttcttgtgttagtttgctaaggatgatgacctccacctagtccatgttcctgcaaaagacatgatcttgttctttttcaatggctgcattatatttcatggtgtatatttagcacattttctttatccaatttgtcattgatgggaatttaggttgatttcatatctttgctatcatgaatagtgctacaatgaacatcacgtgcatgtgtctttatggtagaatgatttatatacctctgggtatatacctggtaatgggattgctgggtcgaatggcagttctgttttttagctctttgaggaatcatcatgctgctttccacaatggttgaactagtttacacccaccaacagtgtataagtgtttccttttcttcacaacctcatcagcatctgttattttatttactttttcattgtagccattctgactggcgtgaggtggtatctcattgtggttttgatttgcagttctctaatgatcagtgatagtgacttttttttttcatatgctcgttggctgcatgaatgtcttcatttgaggagtgtctgttcatgtcctttgcccactttttaatggagtcgtttgtttttctctcataaattttaagtttcttatagatactgggtattagaccttcatcagatgcatagtttgcaaatattttctcccattctgtaggttgtctgtttactctgttgatagtttcttttgctgcagaaacgctcttaagtttaattagatcccacttgtcaattttttcttttcttgcaattgcttttagtgtctttgttgtgaaatatatgcccattcctatatccaagatggcattgcctaggttgttgtttaggtgtttatagttttggattttacatttaagtctttaatccatcttgagttgatttttgtgtatggtgtaaggaaggggtccagcttcaatcttttccatatggctagccagttatcccagcaccatttattgaagagggagccttcctcattgcttgttttgtcatctttgtgaaagatcagatggtcgtagatgtgtgggcttacttctgatatctctattctgttccattggtctatgtgcctgtttgtgtaccattaccatgctgttttcattcctttagccttgtagtatagtttaaagttgggcaacgtgaggcctccagccttattctttttgtttaggattgccttggctatgcgggctcattttggttccgtatgaattttaaaatacttttttctggttctgtgaataataatcttggtaatttgacagcatagcattgaatttgtaaattgctttgggctgtatagccatattaatgatattgattcttcctatccatgagcatgggaggttttttaatttgtttgtgtcttctctgatttccttgagcagtgttttgtaattctcattgtagagatctttcaccatcctggttagctgtattcctcagtattttcttctttttgtggcaattgtgagtgggattgcccttctgatttgcctgtctgcttagctgttgttggtacccagaaatgctaataatttttgtgcattgattatgtatcttacaactttgctgaagttgtttatctgctggaagtgcttttggtctgagactatgtgcttttctagatatagaatcatgtcacctgcaaacagagatagtttgacttcttgtcttcctatttggatgtgctttatttctttctcttgcctgattgctctggctaggacttccaatcctatgtggaatacaaatattgagagagggcatccttgtcttgtgtcagttttcaaggggaatgcttccagcttttgcccattcagtataatgttggctgtggttttgtcatagatagctcttattattttgaggtatgttccttcaatacctagtttattgagagtttttaacatgaagtggtgttaaattttattgaaagccttttatgcaataatttagataatcatgtgttttgttttttgtctttaattttgtttatgtgatgaatcacatgtattgacttatctatgttgaaataaccttgcatcccgggcatgaaacctacttgatcatggtagattcgctttttgatgtgctgctggtctcagttttgtattagtcaggattctctagagggacagaactgaataggatgtatgtatatttgaaagggagtttattaaggataattgactcacatgatcacaaggtgaagtcccatgataggccatctgcaagtagaggagcaaggaagccagtagtggctcagtccaagtcccaaaaactcagaagtagggaagccaacagtgcagtcttcagtctgtggccaaaggtccaagagccccttgcaaaccactggtataagtccaagagtcccaaaaccaaagaacttggggtctgatgttcaagggtaggaagcatccgtcatgggagaaagatgaaggccagaagactcagcaagtcagcttcttccaccgtcttctgcctgctttttctagttgcactgtcagccaattggatggttcccacccacaatgtgggtacgtcttcctctcccagtccactgactcgaatattaatctcttctggtaacactcagaaacacccagaaacaatacttcgcatccttcaatgatcaagttgacacttcatgttaagtttatcacaaatttgcaagtatttttgctgaggatttttgcatcatagttcatcaatgatattggcctgaagttttcttttttgtgtgtgtttctgccaggttttggtatcaagatgctggcctcatagaatgagttggggaggagttctccctcctcaatattttggaatagtttctgtggaatggtaccggctcttctttgtacacctggtggaattcggctgtgaatctaccaggtcctgggctttttttttttggttggcaggctatttattactgattcaattttggagctcattattggtctgtttggggaatcattattcctggctcagtcttgggaggctgtatgtgttcagcaatgtatccatctcttctaggttttctagtttgtgttcacggaagtgatcccagtagtttctgatggttgtttttatttctgtgagatcagtagtaacattccctttgtcatttctcatcatatttatttggttgttctctctttccattagtctagctagtagcaaacattatgaaaatgaatttagacaagatactaactttcaatgtgaatacttctatatattcaaagttttaaacaaatatgagtttacttataatcaaatatatgttttgtaaattgctgtgtggaaatcagaggctgctcatttctcattcaaactaacttaaagatactatgttaaatgttctacaatcataactttaaagttgttttctctaagagtttgaaaaagaaccagtatttttgaggttgtgtcaatagagtcatgattaataacaagcataataaaaatttttattaaaaataagcaattaaatattcttcttttactatattaatgctcctgagaattataactttctaaacaatttaaatgaaacatgagcttttaagcttatagtaggtgctcaaatgtttaggaaaaatgaatgccaaaaatagctatattgtttattcagtggaaggaaaaaagactaaacataatttttacacattgtctgtttatacattactttgctaaaaacttacaaatagatggactcatttattttagagatctgtgtgtgaaatgtattgaaatggattataacatttcccaatgggacacatctaccagcaaagcatttcaggagtgattttatgtatatgtgacgaattaggcaacttatgcttgaaaatatcagaaatattaaacaggcacatctaggggcatttaattcttaccaattttgttttttcctgtctcttaagaaataagagcagggtgtggtggctcacgcctgtaatcctagcactttgggaggccgaggcgggcaggtcacctgaggtcaggagttcaagaccagcctggctaaaatgatgaaaccccatctctactaaaatacaaaaataaggcgatcctaatggcaggtgcctgtaatcccagcgactcaggaggctgagataggagaattgctcaaacccgggagatggcggttgcagtgagcctagattgtgccactgtactccagcctgggtgactgagcaaggctccgtctaaaaaaaaataaataaataaattaaataaataaattaaaaaatgatatagctacatgagctcagtcatcaatgataggctagaaagagtaaattacaaataacaaaaattactatatttaacaattattgtaaactttgacatccatcttcttataatatttgcaataaaatatattttcaatgagatagtgacatggatgtatttttggttataaatcatatgatttattatttcaaaaaaactatccttaatcattaacagtaatgtctttacattgagaaactatgcaaatctcagaatatttgtctcctaacatgttttatgagcataacaaattcaaaaaacacagaactataactcttttgttttacaacttgatacatcacatattgctattctccaaagatttccttcctaattatgttttcttctacataatattaaagttcattgacattctcataatacacaacaggatgtctgcatgaaaattgcctgcaagcaatgttggctgatgggagaatgctagcttatattaaaaggtaactattatggttttatcaatagaaagaaaaagagttaattacattggtacttatctctttcccttttgggccagttaaattattgaattttttttttttttttttttttttggtaaattgaattcttcatgggaaggtacgtcatccacctgtatgaaaacagatatcacaagaaaaaagtatatatagaccaccccccaaaaaacaaacttaataaaactatgtatttcaaatagaattatttttttctggttgaaaaagaaagttggaaacaaaatctgtgacaaaacccaggctttgcctgtactttaacgtaaaccaatgctgcactttatgcttactattttgttgtcttgtaaggagaatttctagagggtggttgggttccatgcaacttaattgtaagtgtcagctgaaagacctacaaagacattgtcagttattgagtttcttatcaagccaataatgtggtacggctgttgtactaataatgaagttttaattagttctcaaaaatactgagagcttatttaaggcctccaaattggatagtgcatgcttagcttgaaggcatcaatgcatcccaaacatatcaaaataactgtcaaacacattgtatacacattaggagataatagctagaaggcttaacatctatcttagaaatactgtatgcacaaattgttcaaggaagttctttctacacttaaatgattgtcttcagaatattgtattttataatttaagcaaattgtcatgcaaatggttcagtgttatctgtttatctgagggtcagtatagttgagaaaattcattttagccaatgtttatcgttattccaaatgggagcattctctattcataactatcccaacatagcacctgcatttttacttataaatacttattgcttgtttccaatattttactgcatgagaaattgtgccagatccctcttccctaatccatgggtagttcaaagatactaacatttaagaaacagttgatttaaacttctaccattggagaattgttgatgtcttttcaatgcattgggtggatttagaccactgcattcttatatgcctgtctattaatgctatacaagatgtctggtttaaactaacattactggaagtaaccctttctaccccatcccatctccacccacacgtctacaaaaagaattttatgcaagacagattttgaagcacatagaggaggagctaacatgagttgctgctagaaaaataatagctgtgttatttgtactgacagtttgtatttcttctcaaatcatttattttcacaaaattggtctggctcttattttttcaaaggacgtaagctacttcattgttgttgttatggatttctgatataatgacattaattacttgctgtgtgccagggacttttttaggcttagagggtgaaagtgtagaactggaagtgcatgcgattcagaggctgcacagtgaccctctgtgggtaagaagtgggctcctagagtatttgaattatgaatgcaagtgggtcaagggaatgaggaatggggtgtatgagaagaataataagcatggagaataggacatatggcttgtttcggggaactacaagatgtttcctatttctgtatcacaattacatgaggataaagggagaggcccaaggatataatgattacaatttgagggggaagtgtttactacattcagagagcctgggtcatattctgttagtacatcatgtttttcgtcaaattttgagtgactattatgtggaggtggaggatcttcttttgatattgatttaaaaatattatttacaaagatattatatattttcttccaagaaaatatagcttatattatacctacaagagttcatgatttgtagggggcaccaaattaagtcggaaatgctaaaatgtcacacatttcaggagaaataaatcagaaagaggtgggtttattggtgaaggatcaatttgatgcatcaaaaagagggttactcttaaattctcgggagaagtgaactcaggaagaaggaaatatcaagtctgacgttaaaatctgatgccaggaaataggaacttgtatataaaagatcctgaatatagctgatgtttaggaaaagtttattaaagtgaattcacctaggatagaaaacaatatggtataattagtagttaaaatgaggatctattagaactttgtctagataaacaaaagaaattaattcatgtttattttttatttttattttattttatttttttgagatggagtcttgctctgtcaccaaggctggaagtgcaatggtgcaatcttggctcactgtaaccgctgtctccagggttcaagtgattctcctgcctcggcttcccgagtagctgggattacaggcacctgccatcatgcctggctaatttttgcatttttgtagagatggggtttcaccatgttggtcaggcttttcttgaactcctgacctcaggtgatccgcccaccgtggcctcccaaagtgctgggattacaggcgtgagccaccacacctggcctcatgtttctttttataacagaaaattgtaattgtgtgactgtgtaacaaaattgtaattgcagctatacttcagttcttcacttaaattgtttgtcaagttttgacatgattctttcaataaaattgtatgataacacgacttctcattctgcttctgtggcattatcacctgaaagtcatttctgcaaagaattatttcagagtcttatcagtttcccaattagcgcttttgtttattttatattcaaaccattttatttttaaaagcctattgtgcaatcattcttgccaatttctcttgatcagaataggtctaactgctttgcacatgttttgaactgttctacatcaacgtcattaactttggaaagacctccttcttttgtaaaatttgcaatttcattattcaatttacatttatttgcattataagtagcgaataactaagaatatattgacatgaaagacagacataggctgaaaggcaaagacaggctctagtgtaaaaaggcagaaaaggatgatttaatggcatctgagattgtaagtggcattttgttatacatattttcatgagaagctgaatttggttctctacacaaacttataactgaagggattcagataaataattctcctatatggagggcctctggaataaacaagattatatcttaggatctgactaaaatggcctcaatgttccccacagcttgattaaactttacacaagctgctgcttaaatctaggccctgacctcccttttcttagagcattccctttagaaaactagtaattgtaaatcctttctctgactctttgagatgtaaatcttttttgaaagtgctttgccagttttaaaacacgaaactgtctttctcaaaagacctggaagccagctcttcgaaatgtaaacatcaatgaagacagagcccctgtcttccagcttctgtgggatagcaggagcctacatttgaaggatgctttgctccaaggtgtaaaactacctcctaagaggcagtttgcttttggcgggggggcaaagccagttaggaaatactggtggcctaaaacccaggtcctttatgacctaattctagctttataaaaatttttcagcttggccaggtgtggtggctcatgcctatgatcccagcactttgggaggttacagcagaagggtcacttgaggccagtagttcaagaccagcctagacaacatagggagaccttatcttaaacacacacacacacatacacacacgcacacacacacacacacacatacacagcaaaaaaaaaaaaaaaaaaaaaaaaaaacaaaaaacaaaaaaacgagaagaagaacaaaaacatctttttgggggcaggagttgcagtacagctcactttgacttttggcttccctcctctcttacattaaactcctggcctgtttaactttgtttggcagattgttttggttttttgctttgacagatccaaataaaataattaaatcagtcaggactgagagatctagatgcatgttgactcttagggagttcatgggatcgtcaccaaatctattcttgcatcacctgaatcttcccaggttgaagatgagagcagacactgaaggtcatattcttgctgctggcttgtatttgctgccaagtcccccagggcatgttctttttccttctgtgaatcaggtcggatttcatataccattttgtgttatttattttggaatttttctcttaaaatagctcctccgtaaagaaagcatattgttcatatcattgtgattatgatttcagcaaaggagataaaactctataataaaataaatgtccttcctagaaaaatatttgagttgaataaaacttcagaatactgccaggaatattgtaactttcgtttgcctcaaaatgctattctgatccttcatctttcattattaatccattcaacaaccatttattaaacccttacatttgtgccagaaccttctagacatactgatttaaaacatgtattctcaagttgcaaaatcgccctccagatcaccctgggtcattggatcaacgatacaataatgtgtattgttgattatcaggtcaacaatgatccaatacacattattgggtcaaaattgttgacctaattcacattatatgtgtttttcactcaaaaagtctggaaggctcagaaaagactggaggaaatgcacattttttcctctgtcatacccatgcatattggttgttctagattagataattaagtagacttagtgcaaaaatcattttattttcatatttcactatttaggttattggtatatttgtaactttttacttttaactactgctttaagcgtttttcattgatgacattaagcatgtaagaaatgatcttaatggttattttgactatagatatcagtgtctttctcattatgtgctttgtataagaaaggacataaatatcaagcaagaaataacaaaagcattgcattcagaaacaagaacatacaagttaatgaaaagaaggtaaaacataattttttcgaccattaaaaacataggaaaggggccaggcatgatggcttttgcctgtaatctcagcactttgggaggctgagaggagaagatcatttgaggctaagagttcgaaatcagcctgggtaacatagtgagacccccccatctctataacaaaacttaaaattagcctagtgtggtgccatgtgcctgcagtcttatctgctggagtggctaaacctggaagatgggttgagcccacaaatttgaggatgcagtgagctatgattgccccactgcactccagccagggtaacagaacaagagcctgtctgtaaaatatatatatatataaaatatgtgtatatgtgtatataaataatatgtgtatactatatatgtgtgtgtatatgtatacatatatacatatgtgtgtatactatatatgtgtgtgtatgtatgtatgtgtgtatatatgtgtatatgtacatatacatatatgtatacatatatatggacttttaaacttttttagcagctctatggctttcagtgctatttggatatttactttgaatgaagcaagattatttgagaactgtttatatttcatgatgtcaccttccatgatagtttttctattataggagattctcagttcattacccgaccatgatgacaagtgaaaactatgaattattttcactaaatcaagtaatcgactttcataaaatacagttcattaatgtttcctcttcagcatattgttttaagatagtcctaagtcattttcagttctttaacataataaaatactcaatagaatacattaaaagaggattcagaacttgtattctttcattttaaaatgtctcctggaaacacaatttactttattttggtgtttattcatgggccaacgtcccctaattatgatagctgtatcttgaatactgttaatgcaaccacttcaatttgagtggtagatatcttctatttattcttctagatccactctccacattttttaccatagtatttggcaggctgctgacttctgtcagtgacattaattgacttcttgtccttgatcttcttcttccatttggccagtggcaaaccctgggaggagaggggaaggaagaaagtgatgatgtattatcttttttttttttctataatgctaacttcattttgctagtcacttaggaatatttttttacagctgaattgctgagtaagactctacattttccctttcccacaagtactcttgagtttttttttttaataagattataccagccctatgtttatgttagaaaagatgacctaaggtaggagttagaaaaccatatctttttaatatcataaagcagacgctgtcattctcttttgaaaaaattatttcactagtttaacttcactctctgaatgaagccctaactcttttaattgccaggaggcccttcataaattgacagcgcctgtttctctgaccccatttctgtggacctcccctgccctcactccactctaagtacatcagctttctcgctgcttctcaaaaaagatgagcttttccttgcctcctgacctttgcaactgtttgccttacctgccgatcttcttacgctttcttccaccctctccactccccattgaaatgtccaactcaaagcagctctgaccactttcaagaactcctagtatctctctaaccccttattttgttttactttgctataatggacacttaccttttgcgaactttatttgctcatttgtttaatgcctttcttcaacaaaatatcagttgtgagggaaaggactgtctgggttgctttcaatcacattttcaaaccaagaaacactccaggcttgtagtaactgctccataagtatgtgtggaatgaaatataatggaaagcagatgccttcataggttgactgaggcagtgtctgtgctgccatttcattgccctgtggcaggcatcattttcccatcactgcatacttgatttgatttactcttctgactattaattctagttactattatcaatagatgttggcatagatgataaacttcctttccactctttctacatttaaaaccattctggattttttaaaattagaattaaatgcatccagttatataagatattcccaacttttatatatcatgttagtaaacatgttttaaaattattttaatgttacatttgataagctgtcaagaggcagtgttgaacaactttatattgttctcttttctattaattatccttcattttctacaagatttaaataaaatatataatattaaattagcatttactatgttacagacactcttatgagtgttttacaggaattagttcatttaagtctcataacactccatgaagtcagtactctcacttccaagatatgggaattaaggcacaagtaatttgtctgacaaatgcctgggtccagaacctggcagggactgtggagctgagagccttctcccaaaatgagaacagcttgtttctacatcttagctcatgagctcacggtcagtgctcagtgaatgttatttttctttataataataaagaaaataaagattgtattagtctgttttcacactgctgataaagacatactggagactgggtaatttataaagaaaaagaagtttaatgggctcacagttccacgtggctggggaggcctcactatcatggctgaaggcaaaaggcacatcttacatggtggcagacaagacagaacaagagccaagtgaaaggggtttcccttttaaaaccatcagatctcgtaagacttattcactaccatgagaacagtatgtgggataccactcccatgattcaattatttcccacctggtccctcccacaacacatgggaattatggcagctaaaatttcaagatgagatttgggtggggacacagccaaatatatcacagataataatgaaaagtttatgtcctccacaaattcacatgttgaaagcctaatacctattgctatggtatttggaaacaggagcctatggtgattaggtcctgaagttggagccttcgtgatgggattagagcccttatagaaagaaattcataaaagctcctttatgctctctctttctgccattcgaagaacaccaagaaggtagccacctgtaagccaggaaaagggccctcactaggaacctgaccatgctggcaccatgtcggcaccatgtcttagaattccagctttcagaactgtgagaaataaatgtttgtttaagccaaacataaatacaattaaataaaacttaaaattaagtaaataaagatcttacctgagtagaaaattctacacaacagtggagttgaaatatgaacccagaggccacagatgggagctttttattacttcattatgttttccctctttatcatcccaactaaaccatttaaggagtatattttctaatactttgatgacaattaggtgtgcaagtacaaaactctgctgtgctgtgcttggttttcccatttatatattagtagaaggagaaaaacattttgtcatctctttggaaactcaaacttacagagggctgaatatttgttttattatcttttaatctgttgtctacaaaatctcaggggatgaaatattatcctcattagattcacaaggacttactaacttcagaaatgtcttcagagatgtgtttgcagaattgtggctttgtgtttgcataataaaccagcagcatttaaatgacattcctaaatctgttgaagctataatgtgagcaaaattaatatctgagagatgtttataaggaattatttttgttaccagccaagtaattattggcattgagtagattccaggaaagtcttttaaaaatccttccagaattttgagccaagtctgcattctttgcactgccatccaatagaaccctatcacatggaacaattctaattccacacacgttactctagatcttaggtattttaacctacaggaaaagccaataaaactgtattggttttctcaagaataaactgaataatctcaaatatgtaaaccaaatttttcatgttttatttgtaaaagcaggttatagaattggatgatctctaatttttcttagagctttaaaattgtgggatttattaggatatggcaaatattttcatcaaatacagtatcttatggaaacccagacatcataagaagtcctacttacaaaatcatcttaaggccctgcctgatttttagcccagtctttaattattcatgtgtgttccatttatttatttattttgggtgaggaggtgggggtcaagaccctggattgggatgaaacttcaaatgctactattggttatgttttgctaaaaatggatgttttctgaaaacatgaaaaatttatgattttttgacacaataaatggaaaatatggatatttcaaaaactaagggaaaaaatagcaaaaaatatatacaagttttacccccaagagttatgatctctgtcacttgtgcttggtgaactgatccctataattttttttttttttttttttacaaaatataaaaacacattatcttcttttattatttttctaccttttattttagagtcaggggatacatatgcagctttgctacaaaggtatattgcatggtgctgaggtttgaagcacaaatatattcgtcgtctagatagtgaccatagtacccaacagttagtttttcaactcttgcctcctccttctctccttcctctgctggtctctagtgtctgttgttgccatctttgtgtccatttgtacccaatgtttagctcccacttataagtgaagatacgcagtatttggttttctgttcccgcattaattagcttaggataatggcttccagctacatccatgttgctacaaaggacacggtttctttcttatggctatatagtattttagtggtgtatataaaccatatttccttcattcaacccacctttgataggcacgtgggttgattccatgtctttgctatggtgaatagtgctgtaatgaacatatgaatgcatgtatctttttggcagaatgatttattttcttttgggaatatacccagtgataaggtttggctgtgtccccacctaaaatctcatcttgaattgtaatccaaattataatccccatgtgttaggggagggacttcatgggaggtgattagatcatggttccgccatgctgttctcatcgtagtgagtgagttctcacgacatctgatggttttataaaggcctttcccccctcttcaccctgcatttctctctcctgccaccatgtgaaggatgtgtttgcttccccttctgccatgattgtgagtttcctgaggcctccccagccatgcagaactgtaagtcaattaaacctctttcctaagttacccagtcttgggcagttctttatagcagtgtgagaacagactaatatactcagtaatgggattgctgagctgaatggtaggtcagctcctagtgctgtacaaaaataagtagcatttctgtacacaaataatgttcaggctgagaaccaaatcaagaatgcgataccttttacaatagctacaaaaagaagaaaatatctaggaatacaactaagcaaagagctgaagaatctccacaaggagaaccataaaacactgctgaaagaaatcagagatgatgcaaataaatggaaaaatattccatgttcatggattgaatcaatattgttaaaatgaccacactgcccaaagcaatttacagattcaaacctattctgatcaaactacaaatgtcactttttgcagaataggttatgtactttttaactatttggtgtgttacataggtaccgtaactgtaaatttgttttatgtagttgtttatatagttctaaataactaatggacttgaattattttagccatggatatgcatttgtacattgtatttttcaaaatttttatttatttcaaaactgaaatacagcatattattctttacaatgttatttcacaatattccctataaaggtgtttccaataatttcagagataacttttaaaattatatttaagctcctggcacatacttctgataattgcattgcctttctcttttctttagttgctagtagtaattctcaaaaaatacgtttttttctatgtgttcaaatttgcagttattgaggttttaaagggaagatttacacatgtgtgtgcacatgcatatttaaaagaaaacagtttttattttcattggaatattctcataagaaccaaataaactttagcttagaaatttaggacaacgaagagaagattttgcgagaactcagcaaatttaagtgtttctgtctctgctccattcctttcaaatgcataagtacatacagccaatacacacacattatcatttgtgaaatgccatcttgttaggttataataaatgtactaaagagttaagaacatcaggacagaatgtttaaaaataatggctctaaacaattgatcaaaacactattttagtataaaaaattagtttctccaatttctccaaaatcatcttatagattatttagaataatttcaagctgtttttttaacatcaaagagaatgttaatgtaagttgttccactttctgctaatatataaaataatcatattatgtttgaagtgtcatttattagtttttttggaagaagccatagtttatgacctatcttggttactattgatgttcaatgaattttaagcatgtaaatagggcattttcaatagaaaagttcatctgatttctaactattattttaccagtaacaaactccgtaatataattgtccctgggtatatgcaggggatgggttccaggaccgtctgcctataccaaaacccaaatattcaagacctgcagttagctctgtgaaatccaggtatatgaaaagttggtgctcctgatatgtgggttttggatccagaaaatactgtatttttgatccccacgtttggttgaaaaaaatttgcatataagtggacctgcacagttcaaatttgtgtgtgaggttcaactgtgcttcttttcttgcatattatttatttgcaggtacattgcagctaaaattggaggaagaataaatttgacaggtagcaatggaatagtggaaagagtggtccctattttggctgttactactatacagctccttctcttcttgggcatctcgaaacctcccagtgccatcttaagaactgagtgagatgtttcctactcagtatgtattgagtatcagctatgggttagatgctgttctaagcatggagagtacaatgttccttgaggtagatgaggtcccatacatatgggatttacattcaggtgatgaataggacattgcactacaggatggggctggagggcccactggagcataagtagagtgcaacagaagacttcgaggagaaagcccatgtctaactggggccaaaatgctgatgagcaggaattagtcaagcaaaattagtcaaggaagggaggggaagtagagagtaaattactttgtaaatgataggctgctactcaaaataaaaagtacaataattattatcattctaaaaacttgtagacaaaattataatttgcttttctagctcccttaaaaatttttacagctctcaatgtcatatatgcctttaaaggtaagtctctacaagcctaatcactgcatttgataagttcaagagtttataatcaatggtggtctaatgaaattttttaaatgcatgtgtatctcccagacccccaaactaaaaatttcatggaaaaatatgtttacatgttagatgagttatgttaactacttatgtttagccaactagttgtgtggtttcttggaaaactattttcagaggacatagaaacaatgtaaataaaatgaaattataatttgcttccgaaatgttaagttactcttaacgtctttggatatttacattgttgattccaataaaataaaaaacctgcagcttacatcaaataaatcttttattttttgcataagaaaatttttaaaaaatgaattattaacaagttagtggcaagaaacgagaataccagggatccagtagtctaatgtaaataataatataggggaatgtcacatgggtaattaactttgaggcatttcctgggatttaaacagtgttaggaaatttggcaaaacaagctcttatatagctgatgtaaaaatgcacacacgttggcattgtttgaattctgccacttcctctagtttgtccttaaaaaagcaagagcaatacatgataattatagttaatataaatggatatctttaattatttaagattttaatcttacagagaaagtttcagcaattatttttattgtcttcagaacttctttttgcaaggaaagcaattagttggacatggattgaaacgagccaataagaaaacttaagtgattctatttgtcatgttttcaattaccgtattgtcttggagtgtgctctgccagtattttaacaactgacttatcacttgaagtcaaagattcttttcagcatgaattgtaaactaagcatttcaataatatgtgagtgtattttgcacaggatagaacttgtcgtgtttcattatgctctttaactctgaatatatgtaagtcggtgtgtgtgtgtgtgtgtgtgtgtgtgtgtgtgtgtgtgtgtgtgtatgtgctttccctttacatttttaagatttcaagaatagactaattctagtacaaattactctaaaacgattccttgtaaagttaacccaattgtttctctggctgcttttataaaaatttgaaggtttattcacccctcaaccctgcaatcaaaactgattttaaaagagcatctgaagcctagagctggaggaatgttttttcatgtgttttattttggtaattactttcttaatttgtcaggatttttctgactctaaggttttcccttatgctatcaattttttgttcagttttcttaaaaaaaaaaaagaaagaaatatctttataccaagatagcaccaatctcactttcaaagctgccaaaatttgccctcctacattcttttattgtttttaatgtttaattctaaaacagacaaagaaaaaaattgcagcactataattctttttggtagatatctccaatgattcacatttgtgccctggtatattcaataagactactaatctttgcctcacagatccatggaaagaataacatgggaggctattgggactgcctggactgtatgtttttttctgtttcttaatctaatattctaccaatctctctttaaaaatgttaattgatgatcacatctttttctttttaggcatttcaaattttgtaacattagtattctgtatgcttagtgtgccaagtaggaatctgcttaaaatcatcaggaaattttcataccaacgtgttcctcagtaccaaaattgtacaatcatcacatggaataagtttatctagtatagcctcctatgtcatgagtgaattctctttatgcgtgaacacgaaatggatttttctgtatttgcttgactaacacaagtgttataaactcatcattttcaagcaactcttcttgctggaaaacttttgctaaattcctgtaatttgccagtgagtgacgtctgccctgctgctcagtggatcataggaaatagacctaatatttctgccatgtaaaaacccttaactcctttatggtgtgtctgtatcccctcatgcttctctccattccccagtctccttatttactcttctatccatcagactaagtattcataaaaatcttcatttttttctatctcagatatctagatatctacatagtttttttgtttgtttgtttgtttgcgacagtggagttttgctcttgtggcccaggctggagtacaatggcgcgatcttggctcactgcaaactcgcctccccagttcagacaattctcctgcctcagcctcccgagtagctgggattacgggcgcccaccaccacacccaactgattctgttttatgttttgttttgttttgtttttttgtatttttaatagagacaggtttctccatgttggccaggctggtctccaactcctgtaatcctagcactttgggaggccgaggcagcggatcacctgatgtcataagtacatggtttttatttatctcatttaattgtaattattttacattaatatcctgcagcctgaccttcattattaataagtatgagtaaagccattgaatcagtttttctttcacattaccatttatttttctgtattttttttctaaaatttctttcagtaagaaattttgttgaaatccaggcatacggtctatattcccctgtattttctctaattgccttgtcaaaacaaacaaaagaattaagttgagtctggccttaataaactcaggctggcttcctgatatgctttttttctaaggtgttaatgcaaatttagcattttattctagatgagattgtattcacagatgtacacttcacaggtcatttccttgaccaccctagcatttcttgtataacctacaattagtcaaaaagaatttatctaagttcttttcttatgttagggtgtccacttttagtcttagagatataaactgacttagggttgttctgtatatgtttatgttatctttgataaccttgatttttagctctgactaccaagtatttaagtccaaaatttatttacttagaaaatctagccaatgaattaatctatcatccattgacattagatcattagcctcaaggaccaggtttttgtgtttttttccctcttcttactcaaacagagttccaaatctttgaaaattatataatatttctttaaacaatgttatttacaacatggtatcattttatttaaccttcattaaatatactttggttttattttgggcagaacctgatgatatctgaatagtagaactcgtgtggaaattttctcaattttataacgtttctatttttttctctccagaatattttatacatatatggctaacaaattaattttaccttactttctatcacttgttaattaactttcatttaccttttattgatatattggtaacaattgtattttactctatcatttcatatgtaaggtaacttccacatcatgtgtttttccttatcaaaaatttaaatttaactatattctaatgctttcctttttagttatcattaaattgaaataatcaagaccaccatttcctaggacctttttcacttctattctgcctacccatttttttttcatcttgataagaatttggtccagattatatagtatatacatacactgaaatattattcagctttaaaaaacaaggaaatcctgtcacttgagacaacatagatgatctggaggacattatgttcagtaaaataaaccagacacagaaagacaaacactatatgatgttacctacatgtgggttaaaaatagtaaaactcacagagagtagaagagtggttgccaggggataaggggaaggggaaatggggatatgatggtcaaagggggcaacatctcagttatgcaaggtaaataagtcctggagagctagtatcaagcacagtgcctatagctaatgatactacgttgcatattacaatttcctaagtagatagttcttaaccacagagacacacagatacacacatgcacacacagaaaataatagagtgggaggaaacattgggaactgatagatatgtttattgccttgatggtgatgatggtttcaccagcacacttatccctaaactcattgcattgtttacattaaatgtgtacagctttttctatattaattatacctcaataaagcagtttttaaaaaagttttaattagttgctttttctgtttttcaaaaaatgttataagtatagctttcttatatatatttagatatttcttcctagggtcattgaatctaaaatatgtgtaaatcttctttgatacagagaaactccagaaatatggtagaatacagcaatagacttcaggacggaggccaagtgtaaatttaaactctactgtttattaaatttgtggtcttgggtaagtctccttaactctcagatgcaagtcattcatctgtaaacagtgagattcatagacgtgtcttcccaatactaagctgtattgtgatatgacttaaacctctatattaaaaatgagctgtaatttgctttaatttactattttattctgcatggtcttcttattttaaataaaatgtacatttccattattgttttttagttgaatcgaaaccactgaatcttgatcatatctaaaattttacttttacatcttcttgttaaaattacaataccttgttcttcatcacttattcctagtgtatagactacggagaacacagaaagttttctgaagctccttcctattatattatcatataaattaccaggcatgtctgtcttgatcatactttcttcatcaatccccatgtctttcttggtatcctgttttataattttatctaggacttttttctcactccgattctaatttagatttgagtattattgatgagattggaaattctccaggcaggcattttctttctcgtcctcattaggagctctcaggtgccctagccaagcgtctatcacttgggtatattcatggtacagaaagccaaatcacattatgtgctgccagccagcaactgagacagagatccaagctccacagcatcccttatcttccaaatttccaactttcattggaagcaaagatgaaaatgccacctgtgtcccaaggtccttcatatttaaaaagtgggaaaatgtattaaagatatgccctgattttgtcttctaccacgacacactcataggctatcttcagatctcgacagtattttatgtagaatgttattttatttcactctcttcaaagtagtcagttgaagctggtatcgctgtcctgaccacaagtgagaaaataagcagagttgtgaagtgctttgcccaaggacccacagatttttaaaagtagaccagatggagaatccagatcaggtttcagccttcatttccagccagcttttcaacatagacatggcaccactttttaaaattttcctgtcagctactgattatattgtgtatttcaaccagagatgccatgttttgaaatatttgtctatcaaacaaaccacatctgttgagttataatttattttccacttttgctaatcaagcatgtatagcttctcatcatcatttttgatgatcatgagctaaaaaacaagttattaaaaataagttaaataaacctaatcaaaataaatgtatcttggtatttacatcagtcattatacaagtaaatgcaaattttctttaggcttttaaacattttgaaaatgacaatggctttgtttccaacatgagtgaaccagtttaactgtggtttacatcagcctgtgtaactatgatcatacatcattacttgatattagccctggaattaaaagacagattacccagcaatcccatttctgggtatatacccaaaggaaaataaatcattctaccaaaaagacacatgaactggtgtgcttatcacagcactatcacaatagcaaagatatggaatcaacccaggtgcccatcaatggtggattggataatgaaaatgtgatacatacatatatatctcatagaatactatgcagccacaaaaaataaacaaaattatgttccttgcagcaacatggatgcagctagaggccattatcctaagtgaattaatgctggaacagaaaactaaataccatacactatcatttatacgtgagagctaagcattgggtacacttcaacataaagaagggaataatagctagacactgtggactactaagtggaggagacaggaatgggttcaagcctaaaaaactacttattgggtactgtgatcactatctgggtgataggatcatttgtacccccaacttcagtgtcacacaatatacccatgcaacacatctgcacgtatacccccgaatgtaaaagttgaaattatgaaaattaaataaaaataaaagacaaatttgcacgatgttttacccagtatgttagctgaaaatatgtaatgttttaggtgaaaaaagtcagaagttatgcaaaagataaattacacagaaattacaggcatacatgaaatatcagctctgtgtatttttttggcagtcccaagtacctgaatgaatatgaacagtttttgttcttattttctggtgaatgattttttacaataatatgacattatgaaggatcttctaacatgaacataacaacagcaaaaatgggcaaatgtctcaaggttgttaatgacaaatacgtggtggtaatcaatcagtgtcagctcccactgtcaccagctggcatagcaggcctcgtcaacacagcactctaagaaactacaatttacctatgaagttggcacaagaaatggtatccatttttttattcttgttataacttttgtatttctgacaatgtttgtgatatcattttacatgaacctcatacacattctactactcattggcacctcttcccacctattaatgttttggccaacataaaattactggttatctattgctgtatcatgaaccactgaaaaacttagtagctttaaacaacagcagcaatatttattttactcatgaatttacaacttgggtagagttggtggcagcagttcatttgtgctttgtgtgccatcagctgaaatggctcagcttagattgaaggaacttcttccaagacggcccactcaatggctggcaagttgatgctgttatcagctgagagctcatctggggccttactttctcctcatgtgggcatttccataggttactgagactttgacagcacagtgcctgatcccaagtatgaattttccatgacacaggaagtgaatgcagccaatcttttaggtccagagccaagaaactggtaacctgtcacattccaatcattccattggttgaagcagccacaaagccagctcagttttaagaggcagagacagacttctcctctcaatgagaagagagccatagaatttgtagccatcttaatttattatgataatgttatttttatctcaagtcaagagataagagacaaggaagtataatcggttatggtgactgcctatctagtcttcaaatatttagccaacatgcatcaaatttcttgccctacaggaagccaagaattatatcttagctgggcgtggtggcacatgcctgtaatcccagctacttgggaggctgatgcatgagaatcacttgaacctgggaggcagaggttgcagtgaactgagactgcaccactgcactccagtctgggtgacagagtgagacactatctcaaagaaaaaaattatactatatcagttctttaatgatttattttttacattcaaatgattcaatgttactcaataagtgaatgtttgcaaaattattccagataggtataaacttctgatcgtaatcttcttgaggactccaacttgatatttaaatctctatatgcagagacaactcatgtttttgtaaacatatataaattcataggaaaagccatgataaataatagtgacagtaattggtaggaaaaaatatatattgtttgtaaagatgttttatacatatggacttttgtggtctgatatgcatacagttaacaaatgcatttattttatatctcttgcattgttatctatttctgtgtcagaagaaagaaggcattttgccccttttgttctttctacctaaaaccagtatataatgagctatttcattttttcctagtcacgatcaaagcataatttcagtttaattttgagttttaaattttatacctttgacagattccttctgaaaagaatttatcgtgctgaagagagttataaaatgcagtgattaaatatatataggtaaatagatattttaagataaatctatcatatatctctatatagagatcatttattacatatatacatatatgtatatatacatatgtgtgtgtatgtatatatgtgtgtgtgtatatatatacatacatatatatatatggagagagagagaaatattttgtttttccctcaggagggaaatgcattttctctcctggagcagaagcatgtacaggttaagaaaaagatattctaagtgggtagaatagatgactgactattcatctgttctagcttccggtcctgcaagaagtttggtgaatgatagctgaatatttgaagactggatagaaagctaccataatcagccatactgcctgtctctttaggatagtcttcaaggaatccagccatttttcctacccactgatgttgccaccttcagcaattatatgtgtgtctatgggttgaggaataatccactaagcgcacatcagttaacaaatgggtgactttagaggaagaagtttcaatagaagaagtaagaagatgtcaaagatgacatcctgcctcttgtggaagatgggtacaaaccgagctatgtaaaaacctaggagagtaatattctggctatcctttaagactatgttcttgaaatatttgttaattagttatttagagaagacagtggatactgcctatagaaactgtgaaaggaccactggttgctcactgcagaggtgtcgagccacctgttgtccttcacttataacacacctgccatttcctggccatttcctaccatacaccaagcaacttttggacaatttcttccaaatacttatactgtttactggaaagggcgtaaaggaaacaatatattctctgtctcctatgtttccaatgacatagtaatgccttagaaatatttcagtgttttaggaaattgtttcttaacccaggttagtatacagaataagggccaaattcctttatatgggaaacaatacccttcgaaatctgtggcttatatttccaaattaatcttttgctcctcttcatctggcactctttgcttcagcatttttaaaactctgtgtgttttttgttgttgttttgtttttcttgtttttgttttgttttggttttctcttgttttaactagttgttttcttatgcttcaatcttttgtacatgaattcctaagcttgaaatgctgctgcccctgtggttcgccatgaaaaataattcaatttaaagtgataactttaaacaatttccttgacctgtgtatctcttttgttgggtgcttttgccttttggtctgcatttttttattaacttgtacatacctctgtaagaacagatagtgtaaaatgttctttaatatttaatttacttttctaattctttgaagaaaactggtgtttcatgtaggttaactttacattcccatcagctaccatacaatcgatatccaataaatatgaatgaacagtgtttgctgatggccgaccttgactgaagaatatttaataattgagtggttgagaattctgaaaaactttttgaaaacactatggaaattgtcagcctcaatgctggccttcataagcaagtactctttgcttaggttactacattctcccaaccatttgaaactgctgtaagataattatttagcatttatattatgcatgggatcccatctacagggacagtttttccttcttgtactgcagtatttcttatgctataatgaaagaaaaaattattctaaacctgtacgtttagcttaagattaatgtgtctttatcttatctaggtgttttaatccccttccagccttctttccctcccttcctacatccttcccttccttccttccttttccttccttccttttttctttccttccttattcttacttccttccccttccttctttccttccttccttccttccctcccgccctccttccttcctccgtccttccctccctcccttcctttctctctctttctctctttcttttttcctatttccttgcattgcaaagccttccaaataaaactaaatttaatcatgaaattcacacaggatatacagttacaaataatggattaggatgtaattagctatatgtgtgtgagtacaataaaatctcataatcaaattatgtgtatctgtagttgtaaaaacataacattgaaacaccatataaattaatttagagccatttttgatatttttgttagtatgtaataattgttcatatttatggggtacatctatgggatataatcacgtggaaatacataaaagtattgctagcttactgatggctcttagacaattacatggcaccatggacacataacttctccgaaaaaggagtttctcttttgaaatgtgagatgcaatgggagaccctcaaatggtcatatctccaaagttaactcattatgtcattgtctcaaagtacctgaataaagctattttgagcttcagtccccgacggcataaattctcattttcacatgagtggttgcaactattcatatgtactaagatttactaaagtatctttctgtggaggattattataaaatattgcattttctcaactactggcaatctaagtacaccatacttaagaagtcaagtaagagttttggataatcgttttccttcctccagaaactttatttttcttttaaatttaaggtgatttattgggatatactattatctaaaatgtcaaatgcagacaaatttaaatctgagaaacaaaataagcttcagagtggtgggataggatgcagaatcacatgaatccagaatgattgatttaaatacccagcataacctcatcttagttttgctataaatacaacaattaaaacaggctcatttattatcacccccaacccattccaaacttgcatacacccttttaggcaatgcctgattcctggtcttgcaggaaagacttcctcttcaactcttttacttgggtgatgcctactaatccttattatctccactaggcagtctccctaattccccaaccacgtgtacatttttttttctgttccccgtagtatcttgtgaatatctacctctacatttaacagtttgcattataataactattttttaaatatttctcagtcactatactctgaactgttgagagctatactgtatgtctttataaatagaatcaatacaattttgttggctgatcaacaaaccaggcaatatcaaatattatgttggtgcaaaagcaattgcaaatttgccattatttttaatggcaaaacccacaattacttttgcaccgacctaatagaatagaaactaagcccaagcaaagtacaataagaaaatataagcttttgcttaaataattctgataattagtttattttcttctgttacaatataattttactttagtaagtaattttactttaataaaattataactagtaaaattataatgtttaggcaaatataaaatatttttaatgatgatttatttaacttattaattaatgagggaaattttaagataaccaaactgggctaaattgcaattaaggatttagataaagagtatttaatatataatgtaagggcaatattttgaaatttcatacaaaactgaatgatgtctgacagagaaaccgtatttctctgcatattgccctggacagaaattagtttcatattgaacacaagtaacctcattttatgagggcatctctcactagacaaaagtcaaaacgtcactcttactctctgccccacagaggtgtaacataatctagaaattggaaaatcaagcccatcattacactgagatactactcagtgtctattttacctgttttcaacttttacgtaacttgtctgacatttaagttgaggttctcgaattcaaatgccaacacatatcagaaggcagttgaagtgcaacaataaggtaggccatgtttgaacttggaggccagcatattctggtgctttaggaaaatcctgatatcagaattctagtgtaaagacttgtgattttaagatttggtcagtaatttaaaatattttaagactctaggccaaacaaagctctttatggttcgtggaggccaaaagccaccagctcgagacctacgttgtagaatccaacaggcaatccagcttccctacagaaactggattttatacactgatttcttgctcagtacgcagattttttttttttcttggcctttaggaaacacttctgctgtggaaaccttttgagagctaaacttttcccttacaaatttgtctctgccctttcttagtacacatcagtgatgatatttttctctagagcagtatcttaaaaagtcaatagcctaccacccactctgcagaatcaattgaccatagttaaatttttaagttagcctcattttttcaagactatcagagatatatttgtctaagtttaatgtgtttttttaaaaataattttgtgtttccttaggaattagataagaaaaattgttggagcatgcctcatttatccccctagaattttaattaaggaatgtttatatatatttttaatatctaaaaacaattcagtgaatgccgtttacaaatggtttgtgatatatacatttcactagcattccagaaatgtgttaaagcttctcttaatgattcctaaaataatcatagaataatatacatggacatcatagtatattattttgatcttttgaaaagataatggaaaaattgatatgcaaagttaactacaaacagtatataacttattgtcaattctgcaattatcttctggattttaatatataaatacacaataatttctgaagttttagaaatttacaaattaaaaaatagagatcacctgctgtgacagaattggccaggaaggtaaaattttaaaaatagttttattgttttcaattggtttcttagtgagcacaaaaatatggagcaaagacatcactcaggaaggatctaagctatatatgtattgattaggattctcaaaatacagaattttctgaacatttgctttccctagttaaatgagagtttcaaccactttattttaaattagttgtgcaactggtatttaaaaaaacaataataataataaaaaaaaaaactcttcttactgcctaaggaaatggcatctattgtgtgtgtgtgtgtatgaataatctaattgagtgtataaactaccacattataaccgcaagctgtattgaaaaataaatatcagctataagactatgttaacttttgtctttgtggtacctaatctccaaagatggcctcagtgacagagtcctcacagtcttcatgtttttgtgtggtttcttccgatactcaatttgtgacttgtttaaccgattgagtacatgcaatgaaaaaaaagacactttgactcttgcaggtgtagaccttaaaaggggccagccctctctactttttaacataatgtctgatctgccactttttttctcattaaaaaaaaaattgctatctctaccttcttcctcccattgcaaacgccactgaaagtgatttttgtcaaatttacctgtcatctccttgttttaaattcaatgaaaccatttaagtgcataaattattcaacctttgtgtggcactggaaactttcttttattcccagtttcttaaaatagcctctttagtttcttccagtttttgtctttgtccagttgttctcaccctgtttgtggattaccctcttccagagaatgttggtattctcatagatccactatctgctttctcttcttattccacacattctcaagtaattttatctaggcccatggctttaatctcatgttgctgacttcccaaattccatctccattacaatcccatttgcttagttccagaatttcttacccagttgccaacaagacaagtttattggacttttcttcggggtcctgaaaccagcatactcaaatcgcattcattcctgtcctcagcacattccaggtgagagccccgaaacctcttcttattctagaaatagaacatctagttgaataagccagaagccaagattcattcctggctcttctctctttcactttccctgcatgcattgaacctgtattttgtgccctttgttttaaatttcactttaacaattcagtttatttctacctaacaacttgtaataaaacaggttggtgtcatggcagagaatgcagaatagtcagtagttgagttctgctcaaaccaattccagatagataggctcacggaagaagaaccaggaaatccaagggataggacaggtcctcaaatttttctctgcctcagaattgtctcagtaatatgcattcaccaacatctggaggacccaaagttagctaaggagcagataatctcaaggaatctttgtcagaaccatcctccaaaacaagtgcttagcaaactgctctatgtgacagtgcattatgataagagcaagtggccctgtttatgggagcttttggatattaaccagtatctcatcccttaaagatagatgtccctataagtgattgttgaaggtggaaagttagaagtaagcaatagtttgagactattttaagtttaccctcaacgagctggaaatcagttatattttatttggtatttactcatttttcaccattatgtaattcaagctataatttcagtactacttgttgttaactacttgctatagacaagtagataagtaaaggcctaaacagtatctcaaaactaaaagaggagatttcctaagtatactgtcaggagcttcctggccatcgggatattttttagtgttgtcctgtagcatagtcaatcaccaaattctgtcagttctgtcatcacaacatctctagagtaaatgtaatacattattcatttttctgttttagtttaagccttattacgatccaactcaaattactcgaataattttctaaatagccttcctgcttctagtcctgaccatctgcaagtcaattcatttgaaagtttttcaagagggaaagcagtttacttaaccatgtctccactccacagcttcaccccatccccaactgttctaaaccttgctctgctctctaagataaaatctaaatgtatttgaatggctgatagggccttatccagtcaagccctggcctatcttgctagtcccatctcctgccactatttctattcccacttcatcatccactcctctcccactcccagtcccatacctcctgattcattctgcttaattcctgtgtttctccccagactccaatgaggcagtacctctgtcagctttctctgaacctcattaggagtctacagagttacctattcatattgctatccgagcgcagaatacttactgaatttcattacactcctatgctcacttggctctctcttctacctgcaccgagtctcttgggaatccagaccatcttattcattcactgcttagcataattcctgtccctagtggacacgtaataaatatcagttaaatattcaatgaacaaatgaatcctctgtcctcataatatactgctttattttatattctaagactatgcttcagaaaatatagaaatcaacaatgctattctgattaaagtagtaataataataataataataataataatgtttctttatctctggacctaagatgtcaacacaggtaaaacaaaagctattttttaagatattaaacttaggctaaaaaacagaaaaatccacttaatgcaaacagcagctacttatcaaaatataaataaaggaatattatggagaaaataattctctagtgtgcttaattcacccgagcctcaacagtttctgctgagtaaaagctataatgcccaatgaagttttacatttccatagaaaacaaaaattatttccagatgtttgctaagaataaaatatctgtatgtatgcataattggtatcaaaaagctagcaaaagcaattaaaatagctttctgtataatttctcagatattatgaatacatggatgaatacacagggaaagaattaaagagcattacactttgtcaatgttctaaataatggaacatgcaatatatgtcctagaaaatggaatttgacttaaacggcaaaataaaagccaaagaggatgaaataaacagaatcactttctaaaatttcatctctgttctagattccttatggaatttgcagtaggaaaaacttaaatatgcaatgagtatattaaaatccaaaggaaatatcagtacttacttggattggatatcaaaaactaaaagacaaagtcagttgtattagatggctggggaaatatcaggactctgaaaaaaattatttttgctaacaattgtattgtttattcttctacttttactaatgtgaactttgaaggagtatatttgttgctctttgagccctttacagtttttcttgcatatatgctcctttttttttttttttttttttttgagacggtctctggctctgtcacccaggctggagtgcagtggtgcgatctcggctcactgcaagctccgcctcccgggttcacgccattctcctgcctcagcctcccgcatagttgggactacaggcgcctgccacctcgcccggctaatttttctttttttttgtatttgtagtggagacggggtttcaccgtgttagccaggatggtgtcgatctcctaaactcgtgatccacccgtctcggcctcccaaagtgctgggattacaggcgtgagccaccgtgctcagccatatgctccattttttactttatcttcctcaggagcagtggctggcagtgagtgtaggggagattgtggctttcatcatatgctctcctgaactactcataatttctcacttttaatccctcttctgaatctaaagaatgcagtgcttttgaaatatactttgtttcttcatccatatttcaaagaagctatattacagtaacgtacatttcttctagtacttaaataactggaacttatatgacacttgggacaaaactggttcatactgaattttgctataataagaaaagagttatggcaagtttccaccacattgtaatcttatatgtagaaactgtataaagggtatgcaaaaacagtatgcagatgaaaattttcacaattcatatgcaggacaaccacctgtggctttcatcactttctcttcatttaagctaacttcccttgcaaacttccatttccactaatgccagagacagtttaaacgagccagtgaacgttaacctagtctcttctggttaactggagccctttcttgtaaatgttccgtctcatgagctgctcctcactttcttatccccaccaataaagtagctgagagcatgtggctgccattgcagcctcagggcagtgaggatgaaatctctgtttcccgagatgggccctcgatgacatggtttttccgacgtgtggtaaggtcatgaaacacatgcccagcaaatcacatgatgtcattgtctcctctctaaccacactgactcagtgactggtcagaactactcgagtagagcatgcagactgcctctggactaccagctgattttactggtcctcaaatgacatatctaccgatattgggagcaagagttggaacacatttttatcaacttcacgttggggcaacattcaagactgtgatctatgggcttgtaccattaaacagggtattgttcagttcaggtaatgccagactcacttctgtggattacacactggccatgcacagtgcgatcaaatatcggaccttgaggggttggataaaatcctgttttgtcaccagagatagcttgagaatcattttcttatgagatatacccattttcacagctgtaaacaccattactatgctgaaaactctctaatttataactctaccccagatctgtcttctgagctcccaactcagcaaattgcatactcaataatttcatttgcatgtaataagctccccaaacttaatatgttaaaaaccaaatttctgacccccactccaacaaaataaaacaaaatgaaactaaaacctgatccttctcagtctttccatcttagaaatgacaactttgttcttttattcatacaaaattagtgaattcatcaagaagatttttatcttttattaccaccctggtccagatctgacctctctctatcctcctgttgcaatctcctttagaaccttaggcaaaggaatcagcggatctcacagacctagagaggagaaaggtggtcaccagaggcctgcagagagagaggaaaggatgggcaaagagaagatattaatcaaaggttacaaagattcagctagactgggggaataggtttggctgatctcttgccccgcatagtgactgccattagtaataatgtatatctccaaattgttaaaagaatagattgttaacattttcaccccattaaaaaagataaattggtgaggtcatagaatatgttaatttgagtttttctctactatatatgtaaatcaaaacatcacattgtacaccgtaaatatacataattattatatgtcaatttaaaataaagttaaatttcttttaaaagtataaattagataacgttaattcaacactcacaacccttcattgctttccatgttacttattaaatagctcaggttctcaaaatagcccacaatatcttaatgatttcaccaataagcaagcttttcagccaccctgcctctaacttactcgtctccattcacactggcctcctggttgttactctagcatagcaagcacacctctgctcaggaaccttatatttgctgttgcttctccttggacctctatacacgtcaccttttcagatagaacatccctgaagaccctctatagaattgtggccccatacctgtactcggtccctgtaatctcgccacgaaatgtggcaggtttacataatactgtacccttagtgtctagaacaatgtcaggtatttattgagaagacattcaaactttgttgaatgagagaattcatctttgtttgtttgtttgtttgagacagagtcttgctctgtcacccaggctggagcacagtggcgcgatctcggctcactgcaagctgcgcctcccaggttcacgccattctcctgcctcagcctcctgagtagctgggactacaggcacccgccaccacgcctggctaattttttgtatttttagtagagacggggtttcactgtattagccaggatggtctcgatctcctgacctcgtgatccgcccacctcggcctcccaaagtgctgggattacaggcgtgagccaccgcgtccggccgagaattcatcttttgagcatggggctcagctcttgtcactgactgtgaatcgtattgtgctgctcacaaagttcaatggttttcttaatgtggaataattttatgtatgagcagatagaagggaaccaagagtaacatctcaagctcacctaccttgaaaagtccctttgtccttacaccttaccaccgcatactggatgtggcaatgaagtagaacaccagcctagtgttcctcaacctcagcactatgacatttggggacagataattccgtgtagtgggagattgtcctctgcattgttgcttagccgaatccttcccataggcctaacaggtgccagatactagtaacaatgcctacctccgcccctactcacgttgtgacaatcaaaaatgtctcctgaacttatcaaaagttccctggagtcgggagggggaaattgcctctggcctagaagatcttggatgcctccttagcctttgagggatgtgaggatttcatcaggagttttataatttggccttcacctaccacacctttctgcctgagactcagagaactgggaatctgtcctcttaggggctccggttttatccacattctcatcacctcacctttaatttccttgatacagaattctttctacattctcttcctatttggaaggacttcccctttcatcctcttacgagttggttccagcagaagtttggagtaaaattctttgatcagagttgcctgagtctggctcttgatttataaagaaagtgtatagaatttagaaaatattttgatcttccacagagactagctttccccaagtctttttcattcagagactcaaagaagtctaatgtgacagtcaaacaacttttctttgtagctgtcatttgccctccttctaaagcatgggacctcagtgggcaatgagtgataagccagtgggtgttactgtattagcagaatgaaacctataacaatttttaacttaatacaataaaatttggtttacgaaggaggagccaagatggccgaataggaacagctccgggtctacagctcccagcgtgagcgatgcagaagatgggtgatttctggaaatcatctgaggtaccgggttcatctcactagggagtgccagacagtgggcgcaggccagtgggtgcacgcaccacaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgagctttcagaccggcttaaaaaacggcgcaccacgggactatatcccacacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagccaggaagctggaactgggtggagcccaccacagctcaaggaggcctggctgcctctgtaggctccacctctgggggcagggcacagacaaacaaaaagacagcagtaacctctgcagacttaaatgtccctgtctgacagctttgaagagagcagtggttctcccagcacgcagctggagatctgaaaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaatagaaaggacatccacaccgaaaacccatctgtacatcaccatcatcaaagaccaaaagtagataaaaccacaaagatggggagaaaacagaacagaaaaactggaaactctaaaacgcagaacacctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaaccggaagaaagggtatcagcgatggaagatgaaatgaatgaaatgaagcgagaagggaagtttagagaaaaaagaataaaaagaaatgagcaaagcctccaagaaatatgggactgtgaaaagaccaaatctacgtctgattggtgtacctgaaaatgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccgaagttgaaatgaaggaaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaagcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctctaattaaaagacacagactggcaagttggataaagagtcaagacccatcagtgtgctgtcttcaggaaacccatctcacatgcagagacacacataggctcaaaataaaaggatggaggaagatctaccaagcaaatagaaaactaaaaaaggcaggggttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacttagactcccaaacattaataatgggagactttaacaccgcactgtcaacattagacagatcaacgagacagaaagtcaacaaggatacccaggaattgaactcagctctgcaccaagcggacctaatagacatctacagaactctccaccccaaatcaacagaatatacattcttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaaatcaatgaatccaggaactggttttttgaaaggatcaacaaaattgatagaccactagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggacacattcctcgacacatacactctcccaagactaaaccaggaagaagttgaatctctgaatagatcaataacaggagctgaaattgtggcaataatcaatagtttaccaaccaaaaagagtctaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaacagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaactcacaagggatgtgaaggacctcttcaaggagaactacaaaccactgctcaaggaaataaaagaggatacaaagaaatggaagaacattccatgctcatgggtaggaagaatcaatatcatgaaaatggccatactgcccaaggtaatttacagattcaatgccatccccatcaagctaccaatgactttcttcacagaattggaaaaagctactttaaagttcatatggtaccaaaaaagagcccgcatcgccaagtcaatcctaagccaaaagaacaaagctggaggcatcacactacctgacttcaaagtatactacaaggctacagtaaccaaaacagcatggtactggtaccaaaacagagatatagatcaatggaacagaacagagccctcagaaataacgccacatacctacaactatctgatctttgacaaacctgagaaaaacaagcattggggaaaggattccctatttaataaatggtgctgggaaaactggctagccatatgtagaaagctgaaactggatcccttccttacaccttatacaaaaatcaattcaagatggatcaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagagctaatatccagaatctgcaatgaactcaaacaaatttacaagaaaaaaacaaacaaccccatcaaaaagtgggcgaaggacatgaacagacacttctcaagagaagacatttatgcagccaaaaaacacatgaaaaaatgctcatcatcactggccatcagagaaatgcaaatcaaaaccactatgagatatcatctcacaccagttagaatggcaatcattaaaaagtcaggatacaacaggtgctggacatgatgtggagaaataggaacacttttacactgttggtgggactgtaaactagttcaacccttgtggaagtcagtgtggtgattcctcagggatctagaactagaaataccatttgacccagccatcctattactgggtatatacccaaaggactataaatcatgctgctataaagacacatgcacacgtatgtttatcgcggcattattcacaacagcaaagacttggaaccaacccaaatgtccaacaatgatagactggattaagaaaatgtggcacatatacaccatggaatactatgcagccataaaagttgatgagttcatatcctttgtagggacatggatgaaattggaaatcatcattctcagtaaactattgcaagaacaaaaaaccaaacaccgtatattctcactcataggtgggaattgaacaatgagatcacatggacacatgaaggggagtaccacactctggggactgtggtggggtggggggaggggggagggatagcatttggaggtatacctaaggctagatgacaagttagtgggtgcagcgcaccagcatggcacatgtatacatatgtaactaacctgcacaatgtgcacatgtaccctaaaacttaaagtataataataaaaaaaataaataataaaatttggtttacaatcttcaagaacattataaccattatatataatacatggtaattttcaagtatctcaaacacacatagaatttcatagagaggtataaatatttatgccaaaacacatggtataatgatttctttcctttgattaagaggcatttttatagtgatcattattaaatgaaataaatatttgcatgtggtacagtatacaatcctttcattacgaaatgttattttaaaagtatgtattgggtcctgaatcacgatgttttaaaatgtttgattttaatgagtcattgaatatgtattagcttttatgagatgcacatatttggaatatggctgtattcgtcagcataaggatgatttaaattttcttaaaatagactattaggatgcagatgttcttgctgacaggtgcttctaaagcattaaaaatacatgtaaccacagtgcttttgacaatgtaattctgttgccttcacacctattaagttgagcaatttcccttatttttctcaaacatgcatactaataaagtcatctatcagtgtttacatatatctaataattggaaaattacattttttatccataataagaaaaaagataaatacaattttgtgggaaatgctatgttagctctcaaataatgtaagtttagcagggcctcagggtaacaatgttttaaattaatcttttggtactatacatcaatttatattgaaatcatcaatttatattcaaatacctgtagtgctaagaccatgttttatttgtaatatcccctttaaacctcaagaaagagtccttattctaatctcataatttagtgataaaatgtatattcactttcccatttgtggcataattttcttagatgtcaaacattatttttctagactgtgaaaaacaaaggctttagtactatttatttgactgcgggaatgaaaataacattgttgagtatctgccctaagccaattactgtgctaatgacttttcttttagaatattgttgcctctttattctcttaatcattttaacattctttattttgacccactgcagtaacatttgatatactcatatgttatacgacaagtaaacatttcatttgctcccttcctttgttgatttcataatttcatgttatatgtagatgatgtcttcaggaaaattaatgactcctttattggttaatggagtttatcacttttcataagacaagtttaagtaatgtctatagattctgggttagataaatcagcaaagtttcatagagaaagagggcctgaacctcgaaagttaattatgctttagaaggcaaaaatgagcagcgggtcttttcagaagcgcatagggaatatgtaggattccctaggtactagtagttggccaggttagctgacgtgcatggtatctgtaagagagctgcgaatatggaaagaggatgaggctgcaacattggtgccttcttcattcagagaaggcactggaatgccaagctaaggggtttgtgattttcctgtaggtcctagaaggtgaaaaagtttgatgaaaatttttacacagagaagagaaagtgagtttgttatttcaggctgctataacaaatgatattagactgagtggtttataaatgagagtaatttatttctcacagttcttcaggctgagaagtctaaaaccagggtgccagcatggttgagtttttggtggtggccctctttcggcaaggagactgccaacttcttgttatatcctcacatggcacagagctcaaagaagcaagctttcttgggattctaaggtcttaatcccatgtgtgaaggctctacccccatgacttcatctaaaccctattacctcccaaagcccctctcctaatggcgtcacatagataagtggggtatcaacatatggattcttttttttttcaataggtttttggggaacaggtggtgtttggtgacatgaacaagttctttagtggtgatttctgagattttggagcacccatcacctgagcagtgtacaccgtacccaatgtgtagttttttattcctcaccaccctcctaccctttcccctgagtccccaaagtcccttgtaacattcttatgcctttgcatcctcacagcttagctcccacttatgagtgagaacatacgatatttgattttccattcctgagttacttcacttagaataatggtctccagtttcatccaggttgctatgaatgccaatatttcattatttatggctttttaaaagtaatgtttttttaaaacattatttatgctttatggctcagtcgtattcatatatatatgaatacacaccacattttctttatccactctttgactggtgggcatttgggctggttccatttttaattgtgaatggtgatgctataaacatatgtgcaagtatcttttttgtatagtgattttttttccctctgggtaggtacccagggcacgattactggatcaaattgtggatccacttttagttctttaaggaatctccacactgtttttcacagtagttgtcctagttttccttcccaccagctgtgtaaaagtgttcccttttcaacacatccacgccaacatctattatttttttttaatttttttattatggccattcttgcaggactaagagggtatcacattgtggttttgatttacatttccctggtcattagtgatgttgagtattttttcatgtgtttgttagccatttgtatatcttcctttgagaattgtatattcatgtccttagctcactttttggtgggattgtttttttgtctagttgatttgtttcagttccttgtagattctggatattagttctttgtctgatttatagattataaagattttctcccactctgtgggttgtctcttcactctgctgattatttcttttgctgtgcagaaagaagctctttagtttaattaggttccatcaatttatctttgtttttttgtttttttgttttttttgcattttcttttgggttcttggtcatgaagtctttgcctacaccaaggtctagaagggttttcccaatgttatcttctagaatttttatagtttcaagacttatatttaggtttttgatccatcttgagttaatttttgtataaggtgagagatgaggatccagttttcttcttccacatgtggcttgtcagttatcccagcaccatttgttaaatagggtatactttccccactttatatttttgtttcctttttcaaagatcagttgactataagtatttggctctatttatgggttctctattctgtggtctacatgactgtttttataccagtaccatgctgttttggtgactatggccttatagtataggttgaagtagggtaatgtaatgcctctagatttgttattttcacttagtcttgctttggctgtgcagattcttttctgatgccatataaattttagaactttttcttctagttttctgaggaataatggtggtattttgatggaaattgcattgaatttgtaacttgcttttggcagtatggtcattttcacaatattgattctacccatgcatgagcatgaaatgtgtttccatttgtttgtgtcatctatgatttctttcagcagtgttttgtaattttccttgtagaagtctttcacctccttgattaagtatattctaagtttttttgttcgtttgtttgtttgtttttgcagctatcgtaaaaggagttgagttcttgatttgattctcagtttcatcactgtgtatgtatagagctactgatttttgtacattaattttgtatcctgaaactttgctgaattcatctaccagttctaggagctttatgtatgagtctttagggttttctaggtatagaattatatcatcagcaaaaacagtttgacttcctctctactgatttagatacactttatttctttctctcgtctgcttgctctggctaggacttccagtactatgttgaatagaagtggtgaaagtgggcatccttgccttgttccagttctcagggcaagtattttcagcttttatccattcagtataatgttgactgtgggtttgttatatatggcttttattaccttaaggtatgtccttctatgccgattttgctgaggattttaatcataaaaggatgctggattttgtcaaatgttttttctgcatctattgagatgatcatgtgattttcattttaaattctgtttatgtggtatatcacatttattgacttgttgatgttaaaccatccctgcatccttgttatgagacccacttgatcatgatggattatctttttgatatgctgttggacttggttagctagtattttatcgagaattttttgcatctgtgttcattaaagatattggtctatagttttccattttgttatgtcctttcttggttttggtattagagtgatactggattcaaagaatgatttagagaggattccctctttctctttctctttctctaaaaatattgtcaataagattggtaccaattattctttaaatgtctgattgaattcaactgttaatctatctggtcctggacttttgttgttgttgatgataactttttaattaccatttcaatcttgctacttgttattggtctgttcagagtttctatttcttactagtttaatctaggagggttgtatatttccaggaatttatccatctcctctaggttttctagtttatgcatgtaaagattttcagggtagccttgaatgatcttttgtatttctgtggtagcagttgttttatttctaactgagcttatttggatcttttctcttctttttttggttaatctcactaatagtctagaaattttatttatcttttcaaagaaccagctttttgtatcatttatcttttgtattttttgtttgttttgatttcatttagttctgctctgatctggattatttcttttcttctgctgagtttgggtttggtttgttcttgtttctctagcctccttgaggtgtgaccttagacagtctatttgtgtctttcagactttctgatgtaggcatataatgctatgaatttccctcttgtcactgcctttgctgtatctcagaggttttgatacgttgtgtcactattatcattcagttcaaagaaatttttaatttccttctggatttcattgttgacccaatgatcattgaggatcaggttatttaatttccaggtacttgcatggttttgagagtttcttttggagttgatttcaaattttattccactgtggtctgagagagtacttgatataattttgattttcttaaatttgatttgtgtcttatcatatgatctatcttggagaatgttccatgagctgataaatagaatgtatattctgcagttgttggttagaatgttctgtaaatatctgttaagtccatttgttccagggtatagtttaagtccgttgtttgttgactttctgtcttgataacctgtccagtgctgtcagtggagtattgaggtcccccagtattattgtgttgctgtcaatctcatttcttaggtccagtaagtaattgttgtataaatatgggagctccagtgttaggtgcatgtatacttaggattatgatattttcctgttgcactagtgcttttatcatgatataatgtccttctttgtcttttgatatggtttggctgtgcccccacccacatctcatcttgaattgtagctcgcacaattcccacatgttgtgggagggacccagttggaggtaattgaatcatggggtgggtctttcctgtgctatacccatgatgttgattaagtctcacaagatctgacggttttataaaagggagttttcctgtacaatttctctctttgcctgctgccatccatgtaagacatgactttgcacctccttgctttccaccatgattgtgaggcctctccagccatgtgtaactgttagtcaattaaatctcttttctttccacgttacccagtcttgggtatgtctctatcagcagtgtaaaaatgaactaatacgtcttttttaactgctgttgctttaaagtttgttttctctgatagaataatagataacccagtgctcttttggtgttcatttgcatgaaatacctttttccacccctttaccttaagtttatgcaagtccacatgtgtcaggtgagtctcttgaagacagcagctacttggttggtgaattattcattatgccattctgtatctttaaagtggagcatttaggccatttacattcaatattagtattgagaggtgaggtattgttttattcatcatgttatttgtttcctgaataccttggtttattttcattatgttgttgttttataggtcctgtgagatttatgctctaaggagattctattttggtgtgtttcgaggatttttttcaagatttagagctccttttagcagttcttatagtgctggcttggtagtagtgaattctttcaaaatttgtttgtctgaaaaagattatctttctttcatttatgaagcttagtttcactagatacacaattcttgcctgacaatgtttggtttaacgaggctaaagataggactccagtcccttctagcttgtagagtttctgctgagagatctgctgttaatctgataggttttcctttataggttacctcatgcttttgcctcacaacttataagattatttcctttatcttgaatttagataacctgatgacaatgtgcctaggcagtgatccttttgcaatgaatttcgcaggtgttttttgagcttcttgtatttggatgtctagatccccagcaaggtcagggaagttttcctcagttattccctcaaatatgttttccaaacttttagatttctcttcttcctcagaaacaccaattattcttaggtttggtcatttaccataattgcaaacttattggaggtttgctccttttttaaaaattcatttttctatttctttgtcagattgggttaattcaaaagccttgtctttgacctctgaggttctttcttctacttgtttgattccattgctgagacttgccagtgcattttgcagctctctaagtgtgtccttcatttccagaagctgtgattatattttattttttgctacatacttcactggagagttttccattaatatcctgtatcatttttttgacttctttatgttggatttcacctttctttggtgtcttcttgtttagcttaatagttgaccttctgaatggtttttctggcaattcagagattttgtcttggtttggattcattgctggtgagtaatgtgatcgtttgagggtgttaaagaaacttgtttttgccatattaccagaattgttttctggttcattctcatttgggtagactatgtcagagggaagatctgggactcaagggctgctgttcagattattttgtcccatgggggtcctcccttgatgtggtgctctcctcttccccttagggatggggcttcctgagagccaaactgcagtggttgttatttgtcttctggatctagccaaccagtagagctactgggctccaggctggtactggagagtatctgcaaacagtcctgtgatgtgatccatcttcgggtctttcagccatggataccagcagctgctccagtggaggtagcaggggagtgaagtggactctgttagggtccttggttgtatttttgttacatgctctggttttgcttttgctcgcctccagccaggaggtggcacgttcaagagcacatcagctaaggcagtataaggaggatcaggcagtgggcggggcatacagctcccaagagattacatcctttgtcttcagagttccttgactgtcccatggagcctgtagcagcagtctacctctttcaaagggtctgtggattcttttggctttcctggtatgttcctgcagtagttcttggagcacaagtttacaatgtgggtctccacatgctgctctgtccatctaagtgggagctgcaagttggtccttcctcctatctgccaattttcctccattctcaacatatggattctgaggagatgacaaacatttaatacataataataagatttaataaaatcatgattttataagcagatagaaaagcctgacaaggggaaatattactaagagagtacatctcaaatgttaccataaaaatgtgaaatactggccaggcgtggtggcttatgcctgtaagcccagcactttgggaggccgaggagagcagatcacctgaggtcaggcgttcaagaccagcctgggcaaggtggtgaaactccatctctactaaaaatacaaaaattagtcgatcatggtggcaggtgcctgtaatctcagctattcaggaggttgaggcaggagaatcacttgaaactgggatgcggaggttgcagtgagctgagattccacgccattgcactccagcctggaagccaaaaatgaaactccattaaaaaaaaaaagtcaaatactgaaggtgataaataggttaattaccttgatctaatcatgccatattgtattgaaaaataataacatcactttttgtcccataaatatacacaacaataatttgtcaatatataattaaaaagaaaaagtgatttctagaagatgtttggaaggaaatcagatggtaaatcatatttactatgtctttaataatttcacactgtagccgtttcatgttttaaaaattgtaataaaaataaaaagtatagttctatacttaaattttttcattgaatgttgaactgtccactatgagggttgtggattttagttaatctttcactttggaaatgcctttgcagactaaattttgtttaagtgcacgagttgtgagtaagcctgaaaatagtttccttttttctaattttgcataaaagtgacataaatgccagctgctgcagctcagagcaaagaaaacagataatagatacaggaaccagtaaaacaatgctttcagagaatagtgctgtaaagaaaataaattaagataataaatggtagggcatattttagggcaatgttatgtaattagtaaaaaatggacattccactgaagctcaaagagctacatgttgtatgattccatgaatatatcttctagaaaaggaaaaattataagaacacaaaacagatcattggtttcctggggcatgcagcagcagaagaggtggactaccaagaggcacagtgaggtgttatgggagattagactgttctatgtcttgattgtggtggtaattatattatgtgtttctcaaaacttgcagaattgcaacataaaaagggtacatttttactataaattaattaggaataaaaactaatgaaaaggaaaaacaatgtcctgagaacaggatatatgacttgagatgcgaatgatgaatcccaggcagatggatctgcaagtgaaacctaagccagaacatccttcgtttgtttgagaaacaggaaggcaagagtcgtgtattagttctcatgcggctaacaaagatgtacccaagactgggtaatttattttaaaataggggtttaatcgactcacagttctgcatagctggggaggcctcataatcatggtggaaggcaaaggaggagcagagtcacgttttacatgacatgagagcttgtgcgggggaattcccatttattaaataatcactactacgagaacagtattggggaaatcacctcacgattcaattatctccacctggccccacctttgacatgtggggattattgcaattcaagatgagatttggggtggggacacagccaaaccatttcaggtggcctgagtctcctaaggaaagcaagggtgggaaataatgagatcaggtagcagatggaaactgaacacgaagacatagtactgtgcctgaaataagcttctgtgaattttctgctaatgtagaaggtcattctaggtcctagacagccttgaatctagaggaagaaagagatgacagaagctagataaatggagtaaagaaaaacatccgttgaatataaatccttccttccatggatgccactgccacccataatagaaaatttcatctcattgtaccctttcagaatgatagatatcacatcagacccacccagtaataatgccagtagtctgtttatatgacatgcacaatcattttaaaatcatacacatatatatataaaacaattgtctgtttaaacttaaagataatattgagatatattaaatgtacatttctgccctgtaattccttcacatgttatatgctatgggcaaagaaaacttaataaaggaaaaaaaaaaaacgccactttcagccttttcagttttctcttaggacaaaattgattttgcttttattgacattgtatagattgtgtcaaatttgcatagtaattctaagcctttccagttaattgacttttatatacaatacaaaaaagtccccccatgtcctgaacgtagtggtgaggcaagtcatttgagtgaacacctgcactcctgtatcaatatatatggttgttttgggaggttaatcaatcaatattttaaaataaaaaggtaaagaaaacaatgataaatatcctaaagacctatgaataggtgagaattgaagagaggcagtatggaattgcagtgtatagtgagaattctaaagttagaaaaacaggattcaactttcatatgccacatattagctctgcgattgtaaaaatgttacttaattcctctgattctaatttctcatttgtaaattggaagtaataataaaactatagggtttctttttgaaaataaaatgagatgcagcatttaacacattgcctggaacaggttaactgttagtttctattacttagagcagcacattgagataactcattaaaatatatctaatattttttactctacgggaaatgggagaaaaaaagacgagtatgtaaaaggttttacttcttaagtgtattactagagtaaagaccacaggaatgcatgcttgacaacataagggaaaaatgttttcaatcacattttaagacagcatagctgatgtagaagggtctagaaaagtcatgcagacaaggtcatgcagaaaattccagccttgactcttttggctgggtgatctggggcaagttgcttaatcttttaaagctcagtttcctctctgtgttttaggaataataaaagtactttccttaaagggtggttgttgagaattaaaagagaggatgtttagcatagtgtctggtacactgtcaaggtttaggaaatacagggataagcagaacatgctggtatgcatgaaggtagcatttacttaacacatgttcactgagtgtttactatgtatggggcattgtgatgaagtttgtaagaaacatcaagatgcacaaggcatcatctctgctattatacagcattcactactttagaaattgatcttcctgacagaagagattgggtttcgttctctgtattctcattgcttggcacagtcgctagcatataatatgtgcttagcaatatttttaaattgagtaactgtaatgataaatacacacacctcctttctaatgaaaactgagtttgaggaaagaaaaattgaattcccttcaagggagaaagagatctcactctttagtggctgttttacctgcttccaacagtattattgtttggctgcttttatttgttgtccgctactcctggtggattttgctcctgttattatcgcattcgtcattataattacttctgacccaaccacaaataggtcctctaatttgatcaagatctctctcgatctttatgcaccaagctcatttatttagtatattggctttcaaagtgtagtgcctggataaacagcatcagtatcacctgggacttgttagaattgaatattcctgggacctatcccagacttactgagtcagaaactcaggaggtgggtcacagaatctgtattttaatgagccctcccagcaatcctgatgcactcaaacatttaagaactgctttcatagcttcccccaactgttgtctctctcttaaagtatatgttttttttcttctgccgcggttcttggaataaattatagaacttgagctgaatgaattcttgtaactaaactgaacaatgacatccctgccatgttctgtcccaatagtgggttccacagagtgccaggctgacactcaggccttgtcaggtttcttgtctctagatccatttctgacctttccaagttgtcacctataaaattagattttttttaaatttttatctttctttaagaaagttgatcctggtgtctagaggtctaattctgcaccacagatcagtttcactgtctggtgacttaaagagtcttaatgctgttggactctgttatgttattccattcactgaggtaggcatggaatccctacagcctccctctctgattcacaaatcacaaagtatttagcaatatatggtagatttataatgttcataacagttagtcaatgtgagacattcagcagccagagttcactttccttaggaggtcagcagaggagacttcttggtgatgtcatcacacttgtcttgaaagacctttgagggccagccactattactaaagaaaaaagtataaggtgataaatagagtaatagtgagataaatatatcactctattctcaggagagtaggaagtcagatgatcttacctaactatttgacctgacactattttttgaaaaaaaattctaatcttaattgtagttctcatttaaagacctgaagagttttttgtttgttcatttgtttttgttttttatatttgtgcttaagctatttcaaagcttatgaatggaaattattttataaatcttttgattcatagaagtttcaacccataacactgaaggaaaatattggcatgccaagaattgtgattccatacaggaatagaatgtcatgcaaaaaaaattaaaaatgtatgttttctgattaatatgccatattcttattttcctggacctttaaaaatcataagaattgctatggatcagcctcacacaccactctttggatggttgtaagttctagtagaagtacatagtgctgacccttttaaaatttctctgttttacacagagaatataataatatatgcacccatattgacttctcttacattttttttctgaaaataatgagtacatctactgttgaagcaaatgcaaagattaatcacttgtaattttcccatcatatatataaatcgcacctttatttctggctttcacagaaagtaagtttcaaaatgagtttcaataaatacatattatcaaagttaaacatgagaatgaatttactttcattaaaaatcaatgttggacattattattaagaagagcaaggtgacaaaaatgtagtggaaatcaatgttggacattattaagaagagcaaggtgacaaaaatgtagtggaaacatccaaatagtcaaatgatctattgttatgaatttacctacgttaaattgatcatttgttaattatgttgttatgttaattatattatgttaattatgttgttaatttgatcattagtgagggaggaagatccagtagttaaagaaggcggggatgctaactgtccttgctatgtagtatgtcacaaggaaaactggtctcagagcaaataacattaaaagcaggcataacaagtgtcataccactctctaagctctattaaattccagatcctgttctttttgatgctctgacaacaccttgaatgtttacttgagatataattcataatattgtagcagcaacattcagctaaccttttggtcaaaatcagggcacatacaaaatctccaaataagcttccgaacacactgacaattcaattctcaaggttaaggtgacaatccagagggctgtaagttattgagatctctgggtccctctacttcattcttttgtgcagaagcaattgtatggcacttctatcttgtccaaactggaagaccagccgtttcactattcaatttgaaagtatgcttatgttatttatcaagcctctagccttgattggagataataatactcaaatgcttatagtagctgactgtggtacatggcctttggattacaattctttagttgctagctaaccaatctttcagaatattttattattaaataactaaccatgaattcttatatttctgattagtacgtttcaaattgtatattaaaaccaatctgctgtgtacatttgtgtgtgtgtgtgtgtgattcattgacaatataacaaaaattttaactttcttgaaaaggatactcttctcctctaacagtactcttctttagtctgtttttagctgtcagtactttgtgtagaaaaatttcctctgatatttgtttataattccaactgagtttatgtctgaatttgaactttttaaacttttccatgaattagactgtgagtttcctaggtagtaagcttttgagcacttatcgtgatgcctgacaaattacagatcctcaataagtagttgtggaatgaatgaatgaattcttgaacgggcctccttccacaattttagtactcagtctattacccaggcttgtgatctctgaaatattttgtagcttttgaatgttatctaacaaaacaatttttaaaacaatcaaaatatttaagtgacttttgttacagtaggaatgatataaagtctatgaattaaatttcacctaaatataaatattacaaagttgtaagggagctcttctagaacaaaaccaaacaaaaaagtagtttatctgtatacaatccaaaaatatggaaatcacttttcttgttcaaagataaatacattatcaaaaaatgtgatacattttagagcttctattgctcaatggatatgggaataaaataagaaaacacaaataacttcgattcagcctttaaccccgaagccacatgtttccactaacaagaagaaatccttgagagaaactttcagcaaaaagaatgttgacagaagagctttgagttagtcctgggtctttgcttaatgagataaagaagcaatcttggcagacaacttactgtaaaattccaacagtctttctcttttcatgtcatcaaaactttaattttctaaatctgtttactgggaagggcaaagagttctcctgtaagacttagatgtgtattttaagttccaagaactgatgagttataaccttgaaactgggaaagctttcacatttcttaaaatgtattgtagaaaactgttttttagtctcttaaagttgaaaactgtatttgctgaaagaggttggttttgcttaccatcatgtggcaatttatcattgaccatgacccagtgatctagctatgattaagtaaatctgatttaaaaagtctgcagtttctccagaattagaaatatatataatgatatttcccttgaaaaacttattttgtaagtaaaagcagtatctaatagattaactttaaaacataatgtaaaatctttttgtgtaaatacaatatacaatttgtataaagatatacaatatacaatttgtataaagatatacaatattactcctggaataatagcatgcatgcactgcctttttttcgttaaggtaacacatttctatgacatttttaagaagaaattgttttaaaatatctatgctaaaaacatcattacttttcttggtcctaaccctgatcaccagtctctggaagcaatcactttcactttaaatgtgtgtgtgtgtttgtgtgtgtgtatgtatacatgtatatgtcttgggcactttcttcagagaatttcacaggtgtaaatggaataatcaggacatatctatatctctttatatatttctatagagagagtgtgtgtgtatacatatgtatatatagttacagtgtatatatagagaaagttatataatgtgtgtgtatatatatatatatataaatatatatatgtatatgcatataattttccttataaaatatccctcctgtagtcctccatcctcctgtttctacctgcattcttcactgcctgggctggctactcctggtatttctctttgtcattgccctgattatgagaggctaaacaaaagtcatagatactttgtaaaacaatgaccagtgtaaaaataaaaagtaaacaagtgtccaaaagttctaatgggtgaataatattcaactgtattgttttaccataaattttgcaataaaatccctgtcattatcatttaagttcctctttacttactaacatttctctaaacagtcttgcataaaattgatttgtgtaattttctaagcactgtggatatggatatgtttccatggcaaaattttaatgttggtcgttctgggtgatgtgttcataggctattttattttaatgataaaatttgttcaattcgggactcgcagccaagatggccaaataggaacagctccggtctacagctcccagcatgaacgacgcagaagacgggtgatttctgcatttccatctgaggtaccaggttcatctcactagggagtgccagacagtgggtgcaggacagtgggtgcagcgcaccgtgcacgagccgaagcagggcgaggcattgcctcactcgggaagcacaaggggtcagggagttccctttcctagtcaaagaaaggggtgacagaaggcatctggaaaatcgggtcactcccaccctaatactgtgcttttccgacaggcttaaaaagcggtgcaccaggagattatatcccgcacctggctcggagggtcctacgcccacggagtctcgctggttgctagcacagcagtctgagatcaaactgcaaggtggcagggaggctgggggaggggcgcctgccattgcccaggcttgcttaggtaaacaaagcagccaggaagctggaactgggtggagcccaccacagctcaaggaggcctgcctgcctctgtaggctccacctctgggggcagggcacagacaaactaaaagacagcagtaacctctgcagacttaaatgtccctgtctgacagctttgaagagagcagtggctctcccagcatgcagctggagatttgagaatgggcagactgcctcctcaagtgggtccctgacccctgacctccgagcagcctaactgggaggcaccccccagtaggggcagactgacacctcacacggccgggtactcctctgagacaaaacttccagaggaatgatcagacagcagcattcgcggttcacgaaaatcctctgctctgcagccaccactactgatacccaggcaaacagggtctggagtggacctctagcaaactccaacaggcctgcagctgagggtcctgtctgttagaaggaaaactaacaaacataaaggacatccacaccaaaaacccatctgtacatcaccatcatcaaagaccaaaagtagataaaaccacaaagatggggaaaaaacagagcagaaaaactggaaactctgaaaagcagagcgcctctcctcctccaaaggcacgcagttcctcaccagcaacggaacaaagctggacggagaatgactttgacgagttgagagaataaggcttcagatgatcaaactactccgagctacaggaggaaattccaaccaaaggcaaagaagttaaaaactttgaaaaaaatttagacaaaagtataactagaataaccaatacagagaagtgcttaaaggagctgatggagctgaaagccaaggctcgagaactacgtgaagaatgcagaagcctcaggagccaatgcgatcaaccggaagaaagggtatcagtgatggaagatgaaataaatgaaatgaagcgagaagggaagtttagagaaaaaagaataaaaagaaacgaacaaagcctccaagaaatatgggactatgtgaaaagaccaaatctacgtctgactggtgtacctgacagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcaattcaccaaagttgaaatgaaggaaaaaatgttaagggcagccagagagaaaggtcgggttaccctcaaagggaagcccatcagactaacagcggatctctcggcagaaactctacaagccagaagagagtgggggccaatatgcaacattcataaagaaaagaattttcaacccagaatttcatatccagccaaactaagattcataagtgaaggagaaataaaatcctttacagacaagcaaatgctgagagattttgtcaccaccaggcctgccctaaaagagctcctgaaggaagcactaaacatggaaaggaacaactggtaccagccactgcaaaatcataccaaattgtaaagaccatcgatgctaggaagaaactgcatcaactaacgaacaaaataaccagctaacataatgacaggatgaaattcacgcataacaatattaactttaaatgtaaatggactaaattctccaattaaaagacacagactggcaaattggataaagagtcaagacttatcagtgtgctgtattcaggaaacccatctcacatgcagagacacacataggctcaaaataaaaggatggaggaagatctaccaagcaaatggaaaacaaaaaaaggcagggtttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacatagactcccacacaataataatgggagactttaacaccccactgtcaacatcagacagatcaacgagacagaaagttaacaaggatacccaggaattgaactcagctctgcaccaagtggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactgtctctcagaccacagtgcaatcaaaccagaaatcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaaaagaaagcagaaaagatccaaaactgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggaactggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacaccctcccaagactaatccaggaagaagttgaatctccgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacactgatgcaaaaatcctcaaaaaaatattggcaaactgaatccagcagcacatcaaacagcttatcaccttgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatggcaaaataataagagctatctatgacaaacccacagccaatatcatactgaatgggcagaaactggaagcactccctttgaaaactggcacaagacagggatgccctctctcaccactcctattcaacatagtgttggaagttctggccagggcaattaggcaggagaaggaaataaagggtattcaattaggaaaagaggaagtcaaattgtccctgcttgcagatgacatgatagtatatctggaaaaccccattgtctcagcccaaaatctccttaagctgataagcaacttcagcaaagtctcaggatacaaaatcaatgcacaaaaatcacaagcattcttatacaccaataacagacaaacagagagccaaatcatgtgtgaactcccattcacaattgcttcaaagaaaaaaaaatacctaggaatccaactcacaagggatgtgaaggacctcttcaaggagaactacaaaccacttctcaatgaaataaaacaggatacaaagaaatggaagaacattccatgctcatgggtaggaagaatcaatatcgtgaaaatggccatactgcccaaggtaatttatagattcaatgccatccccatcaagctatcaatgactttcttcacagaattggaaaaaactactttaaagttcatatggcaccaaaaaagagcccgcatcgccaagtcaatcctaagccaaaagaacaaagctggaggcatcacgctacctgacttcaaagtatactataaggctacagtaaccaaaacagcatggtactggtaccaaaatagagatatagatcaatggaacagaacagagccctcagaaataatgtcgcatatctacaactatctgatctttgacaaaccggagaaaaacaggcaatggggaaaggattccctatttaataaatggtgctgggaaaactggctagccatacgtagaaagctgaaactggaacccttccttataccttatacaaaaattaattcaggatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctagtatccagaatctacaatgaactcaaacaaatttacaagaaaaaaaaacaaacaaccccatcaaaaagtgggcaaaggacatgaacagacacttctcaaaagaagacatttatgcagccaaaaagcacatgaaaaaatgctcaccatcactggccattagagaaatgcaaatcaaaaccacaatgagataccatctcacaccagttagaatggcaatcattaaaaagtcaggaaacaacaggtgctggagaggatgtggagaaataggaacacttttacactgtgggtgggagtgtaaactagttcaacccttgtggaagtcagtgtggcgtttcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatgtccaacaatgatagactggatgaagaaaatgtggcacatatacaccatggaatactatgcagccataagaaatgatgagttcatgtcctttgtagggacatggatgaaattggaaatcatcattctcagtaaactattacaagaacaaaaaaccaaacaccgcatattctcactcatagatgggaattgaacaatgagaacacatggacacaggaaggggaccatcacactccgtggcctgttgtggggtggggggagggggaaggggggagggagagcaataggagatatacctaatgctaaatgacgagttaatgggtgcagcacactagcatggcacatgtatacatatgtaactaacctgcacattgtgcacatgtaccataaaactttaataataataaaattaaaaaaaattgttcaattcaaattttcaacaatggacatgtattcgcatttataattttgaaaagaaaaaaatggacaatggtatttttatactattttaagctccccaatggcagacattattttcactgaatcatgaccaagtcaagttcagtgctgggaagaggggacttacattaaatatataatcagttacttccaggctctgcctcttattggataaggatagacactgtgacatcagagatcaccgtgctgtggaccgaacaaatgccatgtaaacagtgaccatgaccttttatgatcactgtctttctggaatttgacaaactcagagaaaagtttagaggaatgtatagactaaatagtccatttgctattgtgacattgatgatgaaacctttaagaaacttttgatttaaaatgtgttcatgaccttgtgttcataatttcacaattgagaggcgtccctccacattcttggaactgtgcacccattggaacctttaaggtaaatctaaccagggaagtttctcctcagaagaagatggcatccttgatgtgaacagcttttcccaagatcatgaatcaagacttctgtactatcttgagactcttatctttgagtaatttttccccttgtttaggcctctatgaacaatagaaatgaaaagaggtcttctgtgtgcacttactgggtatacttttacttgtgaaggatttggcagccagacttatatgtagataaccttatattttgatagataaaatatgaaagcccaatgtaggtgagagacttaaatggtacatacgttgcctcataatcagtcagaaacagaactttggttcactccctttgacccacatcatgtgttaaagagaaggttgccaggaggccttcactcttctagaagggcatcatttgttaggtactttttccatggtttggagtaaaagaagcaatgattagaaatgtatccctcatgataagctgtctagcaaactctactttaaaggctataattacacagcagattttaaattctcttgtgaaagttatgctaaataatcgaattgctttagattgctgactggctaaacagaagtatctgtgcagctgctggcacttatgtcttgtggagaaagcattgggtattacagacactcagttgtaggggattaagaagaggactacttaatcaagcgagtaaactctttatctagctcattctttgatctatttgattttaagtgatttggtttatggagaccctagtagggaccatactttcaactcttggtgttatcctcccgatagtcataatagaagtctccctggtgtgctgtatgctctcaaaggttttaaatgtttgcattcagacatctccagaatgtcaggtagtctctcttcaacagaaatgacaagagctgaaagaactatgcaaccatgggaaaaccgtaatctatgaatgaggtgctaagaccggaaacccaaaatgatggtaactgagagtagcattaaggccctaaagtttggtcacactctcacctaaatgagaacctgaccaaaaagggggaattcttaaaacaaaattacgggaggctattgtttggactgagctcaatcactaggcaccaacagaagaaactgtataaaaatggagtcacttgtgctaagtgtgacataatcaagctaagactttaaggaaacacatagatcctagaacagacgaggttttgtttttctcctgcaaacaggacgtttctgtataaggaggtaccatctactcaatcctcattcccaccttgcaaaacccactgttctactgttttccagtgggtttcaagaccaaataagtacatttacgatggtgatagtgacatcgatgaataaagttttggccaatctctcaaaattgagaaaatgaccaaaagcggggaattgttaaagcaaactaactgtggcctaagaaggactccttacttttatatctgagtccttgtggatgaaccataacctaacttaataggtagacaagattgaaaacctgacttagaagtatgggattgtcacaatatctgaatcttggcaaatcccagcagccatacttcaaccagtcatagactgctgagtgtttaaactgtgttcaaagagggcaaacactgaactgtaaccaatccagttgtttccatacctcacttccaatttctgtaggccacttcccttttatgtctatagatcttcttccaccatgtggctgtactagagtctctgtgaacctgctgtgattctggaggctgcctgattcacgaaggtttcattgcttcactaaactcctttaaatttaaaataaaataaaatgtgttcatgaacatgagttctaggttggttttggcagttttgtaagatcaataaaagcttcatttaatttatttgaaaacagtgtttaggaataccccaaagtatgttctcacatcgagggatttagaaagtgaaaaccggccgggcgcagtggctcatgcctgtaatctcagcactttgggaggccaaggcaggcggatcacgaggtcaggagattaagaccatcctggctaacacagtgaaaccccgtctctacttaaaaaaaatagaaaaacttagcagggtgtggtggcacgcgcctgtagtcccgggaggtggagtttgcagtgagctgtgatcacgccactgcactccagcctgggtgacagggtgagactcttgtctcaaaaaaaaaaataaaaataaaataaaataaaataaataaaagcgaaaaccgactgttaatacttgtacactttcaaaatgatgaatattttaaagtttaagttgttctcactagagttaactccaggatttctttatttctgttaagaagaggaaaccttgctatgggtagtgcttttctcacaagcttttctcacaggggcacttgcctgaaattatgtggtttattttggtttataaaaagtggctgggacaaggctgcaaaggttggtagtaaagtacctgacacctgccctggaaacttccattggctcttgctcttacttttattttattaaaaaaatgcacgtgtaagagagatggtgttgaatatgttgtaattataaataatgccaacctaaaataattaaaaagggttagaatctagtttaataagagtttattcaagcacaaagtttgaagacagccactcaggaagcacaggttacaaagactaaaagtcagtgttctgatggtagaagcttagggttgtttatagagacaaagtttaaggaagctaaaaagaatttcaacatctttctgtacaaggctggatgcatatttacaatgatctgattagttgagactgtatttttctttcaggaagggtatatttaacattccaccctgaagatgtaacagtcatgaggtcgtttgaaccatctggtctgagttaggtacatgacaataaaagaggtagttaatctataacaaagataagtgaattgaaggggtaagatgtctgatctctagtctcccctagtcatttacagagcaagaacaatgaagaagagagtaaatctataatctaagaagctgaacttgcacacatactatgtgactcatctccaaagcttaactttccccttggcgtaataaattaagagcgtcctaaaattacaatccacagataagtatagatacagcgctttatatgtgtgtgtttatatatatctctctgtatatttacatatataatatataagtagtagaagtagaagtagttttatatattatatatacatatatgtgtgtacatgtatacatgtgtgtatacatatgtacacatatatatgtatatataatatataaaactacttcttttgtacattgtattctgcttctaagaatgacatcactgcaaaaacaaatccctccactccacatccatgttacagtgaaacatttctcattaatgctccatcacttattaatttaaatgttagattctgtttagggtattatgtttataatttttattctgattgccatgtaaaaatatttcgttaaaatattgtaaagtatttttgaaatgtcttgctaatcttattattctgtatattccttattagcccatcagcttctcgagggacaaaaaattacgcatttcatttttattttgtgtgctcaaatctattgtcttattcatcattcaacaaatatttattgagcttacgatataccaagccaagcattagatattggtagtcccagaaatctaacaatcctgatgaattgagtgattattgaaagtgaatttacaaattcatcatccttctatctaagttttagtgcagaaagacattgtcaatgcaggctagcctttactgtaggacaaatggaaacctgacatttacaagaaaatataatttcataatgtatctaggaggaaaaatatttatcactgccaacccaggaaaaaatagaaaacttaacaaatgctaggtattgaccaaagaaacacatgatcaactgtaaatctacccccaaatgagaaaaaatgcattttttcttctactagtagctctaagcaagcggcagtctacaatgttttttcttgttctatagtatgtttcagaaactcacaataggagttcgttttgaattcttctgtgtagctcattttccatttggggaatctatttcttatccatttgtccacatctataactagcaaatagagaattcaatatagcaaatgtgcctacagtaaattcaaaattgcctctcatccatttgtgagcaacacataaataatgaaggcgacattaaaacttcgggtttttttatttttacttctttctctgaaatatcttttccagcaaaataaatggtttgaaataattatctatttagaagcactgcaatagctgtgggaatgtgattgccatttacctttcaggattttacggttcccatgagaagaagaaattttttgattccttgattctcttttccttcattatacttcattcttaacccatcagttttttaatttgcctgtaatagatggggctcagtgtctcaagagcatcccaattttatggttatagaaaccagacttagtagacaaaatgtttccttttgagcaaagacttagtggttttagcacctacaaaaaaactaaaggaataaaatggaaatgcaagggaaaccaaaatgcattaaaggttaaatttttcaatatttgtatttctttcttaacttggcacaaatgagattttttttcagttttttacattttatttttgactgctttgaatagtgtcggcttgccaaagtctcaccggactaatgcttacagcagaatttaacacattgccaaactaaccctgaggtgtggtttacactacagaaaagagtgttttggcacaattgccaatttagaaagtacgaaaggagtggcagaacttattgccatagagttagaattttacatctatactgcctattttttaaaatttaatatttcattgatgtcacgaaaaacattctcatgcgtcatattttggtccctttctttttttatttttattatttatttatttattttttgagatggagtcttgctctgtcgccaggctggagtgcagtggcacgatttgggctcactgcaacctctgcctcccgagttctcttgcctcagcctccctagtagctgggattacagtcgcccgccaccacgtccagctaattttttgtattttagtagagacgggtttcaccttgttgtccaggatgtcttgatctcctgacctcgtgatctgcctgcctcagcctcccaaagtgctaggattacaggcgtgagccaccgcacccagccccttatttttttaacagagtgttaaaggtggagtgtggaaggtcttaataaattatgtgtttgctgtgtgtatgtattaccatattacacatgcagtgataagaagccattctcatgataccttgttggccaaactgggttgaaattgaatttaagctccacagagattgtgactacacattagtgtagtaaatatatatatatacacacacacacacacacacaatatggtgtgtatatatatacacacacactgcactatatatatatacagtcgtatacatacagttgctgtatatatagttgttatatatatgtgtgtgtgtgtatatacatatagagagaaagagagagaaagagagagagagagaattgttatattatcttgctaaatgggccactttctaattatataattaccatctttgtctctttttacagcttttgacttaaattgtattttatctggtttaattctagctattcttgctcttttttaaagtttctatttgcatgagacatctttttccatttctgtactatagttaggtcctatttttttaaaccattcagccacttcttatcttttggttggataatttaattaatttacattcaaagtaattattgataggtaataacttactacactatattgttcattgtttcccagttgttttgaagattctttcttcttctcttactgtcttctttgtggtgattttctctagtggtacaattattttgttgctttttatttttagtgtatcaaagttatttgctttgtgattatcatgaagcttgcaaaagtcatcttacagttataacaggatattttaagcaaaagcaacttatctttgatcacaaaaaagcaactctacactttaactctacttcccctctacatttcaattttggatgtcacaacttttatcattttatattggataatccttaacaaattactgtagtgattactaatttaatagttttgtcttttaaccttcatactaatgatatacatgatttacacaccgccattatagtatgaagatagtctgaactttactttgtattttctcttaccaatgagttttattctttcagatgtttttgtgttaatcttagtgtcctgttctttcaactcatagaaccctctttatcatttcttctaacacaggtttggtggtgatgagctccctcagctttgtttgtctagaaaagtctttgtctcttttttatttctgaagaacagttttcctgggtatgctactcttggttgacagatttttttttttcttcagcatgttggatatattatccaaatcttttctggactgtaagatttctgctgagtgtgtctccagttaggtatattggaacttccttatatgttatttgctgctttagtcttgctgttttcagaattctctctttgtcttcaatttttgatagtttgattttaatatgtcttggggtattcttatttgtatagaatctgaatgaagaactttgaccttcctgtacctggatatttttatcttttcctgagtttggaaatgtttctgctcctatttctttaaatatgctttctattcttttaatatttctctttcctttatttaacttctataactcatatagttgcttttttgatgttgtctcataattcttatgcacactggaatggaatggaaaaataccttcaaaattctatgaagaaaaaatatagatgtaaaattctctacataactaaactatcagtgaaacagtgggttagatgaacaaatttatatatgctggagcctaaaagaaaaaccaactttactcacttactctccctcagcagagagaataagatatgtgaaggcgctcatcaaattcaaataaatgacattacagttattgaaatatataatacatgggagaatgaaagaagattgggaaaaaggagtgaggtacaaggactattacaagaatgtggctgaaaaacagaaaatgtttcaaaatgattgtaactgttattacaagctatatatcagttattattaaaaacaaaaaacttgcataaattaaaataaaaaggccgacactgcagtgggaggaaaaggacaatatatatgcaagaataacttactgaaaagacacaggagtggccaatgaaaaacaaagaatgcatgttcaacctatcattaagaagaataataaatgaaataccacaattacctattgactgagaatcaaatttatgtataatgccaatgttagtgtgttttggagaactgccaatgccaatgttaattgttataatctttccaaaatatcgacattgaatgttgcctgcatcaacactaaaataggcttaatctttgaccttactattccaccttttattataaatgattgggaatagctcttaaaggacattgaaatgtttctattacaacataatttatcacagtaaaaatttagaaatagtgttcatttttacatgttggcttaaaactgtaaaataaaatagagtgtacaattaacccttgaacaatgtgagaattaagggcacagacccccctgtcatgcagtcaaatacccatatataatttttgactcctaaaaaacattatagcctactgttgaccataagccttacttgtaatatagtcaattaacgtgtattttatgtttatgtattatatactgtattcttactttaaagagaaaggaaaatggtattaagaaactcataagaaagagaaaatgaggccgaggcaggtggttcacctgagatcaggaattcgagaccagcctggccaacatggcgaaatcctgtctctactaaaaatacaaaaattagccgggtgtggtggcatgcacctggaatcctagctactaggcaggctgaggcaagagaatcgcttaaacctgggagacagaggttgcagtgagctgagatcatgccactgcactccagcctgggtgacagagtaagattctgtctcaaacaaacaaagcaaacaaagaaaaagagagatagagaaaatacatttacagtactgtactgtatttatcaatactctaagttacatcatctgtttacaaggtgaattgttggtctgaagtagtagcaaccgcagctgcaggcttctgtctatggtacatatcatgccatttagcttttactggtgatgtcatgacttttctctgcttcttgggagcacttcgagcatcactagtggcaccttgtatgggccccatggtgtcattcaagatttacagtattgcactaaaaatgataagaactacaggagaactgagagaaattacttactactgcaatactcaattactggagagataaactgcttacatgaagatgattagcataacacagcattttaggaggatactgacaacaccagctcaccgcaatagcagtaactataaagttattactatagtttaatttgtactatagttaattttatagttatgatttaatactgcacctttacttttgtttatatttctctcaactgcaaatggtaccatatatggtctgcgtttctgtgtgtaagttttgataaatttgaacttttcatactagatttgtgtatcatttatggtagtaaattatgaaatagacgagtatcaacatatattttatatgttcctgacatggctatttttttcttaatttttctatatttctaggctgtgagattcatctacaggtttttttttttcaaattgttgcaaatctccaatcatttttcaatacgtttatttttaaaaatccatgtataatagacctgtgaagttcaaacccatgttgttcaaagatcaactgtagatttttttaattttacagttatcaagcacatttattatgtgttgcatatggtatattgaatcttaattctgtgttatatcttaatttttatgaaacaacctactgtagttataaatatgataataaattagaaaatattcataaaggaataatgttaagtggataaggtaaaatactaagcagcaacgatgacattcctaaacttgcaagattattaatgtagatatacatatgcatagaaaaatcttaaggctgcccaggcgcgggggctcacacctgtaatgccagcactttgggaggccaaggtgggcggatcacgaggtcatgagatggagaccatcctggctaacacggtgaaaccccatctctactaaaaatataaaaaaattgctggacgtggtggagggcgcctgtagtcccagctactcgggaggctgaggcaggagaatggcgtgaacccaggaggcggagcttgcagtgagccgagatcgtgccactgcactctggcctgggcgacagtgcgagactccgtctaaaaaaaaaaaagaaaaagaaaaagaaaaatcgtaaggctatgcatagcaatttaatggtagttgtctcaaggtggtggggttatgaatgatttatgttctgtcttttctgttggcatttctttttatatttttcttctgtgaacacctgttgctataaaaatactcagtgcacgtgataataaacatataaagcattctgtatagtctcactgacatttgaaaaaagcctctaggttttatttctcattgtgatcattgcaatgggcatcagaactgcatgtgtaaaaacgatcttgtctgttcttgttatcgtctgcaccctttatctaacatctgtatcactgcttagctggaagcatctcctttagcacggcactgccatgttttatgttctaatgtaaacttgtgtgacttagctatggttaaatagaaataactggtgtttcagcttgatttttgtaacagattctgaggcacgtttttctgtctcaacccgggaatatccatttctgcaccaggacaaattaattacaatactgatgtttaagtatttatggttagtcaaatcttgaatcaaatcgtaacagaaatggaaaacagaaaataagaagagagaggagaaggggaggaggaaaaaggcgcagcagcaacagctattttgagagattgggaaggatcttaattgaaaaaaattgttctttccccaggcttggtcggcgaatcacttaatccactcatcccttcgtcttttcatagaattaggaaagatatttagctcaggccctagaatcagactaatgctgactcgttcttgtctcgaagggctttctacaatttactgcattcagctccatactattaataataatgttgctgcttttcttaaaatccatgttggaaatgtaagaaaatgtaaagaaaattttatttcatatttcattttacatctccaaagcccccaccatctccagaaagagtacaatgatcattttctttgtctctttatatttgaacaatcatcacaacactaaaactacttcgccgttgtgctaagacctcctcctgcctagattgccaccatggcccaccttctccaatttagaagagggaaaggtggggccaaagagagacctttggtgggttttctaccaataagtttaaaaagatactgaaaaggagacccttccttccttcccttccttccttccttccttcctttccttctttccttccttccttccttctttccttccttccttcctttcttctttccttccttcctcccttttctttctctctctctctctgcttcaaatacactttttattcccctgtagaatcagaaaatatctgactgcttgagtctaaatctaccagactaaggaagcctcggaaaagcttttactatttcctcttccctgtctgtgatttttaaaagcatagaaataaaagttcattgtttttatgttatttgtctaaatatatttccatgatatattttaataaaacattccttaggtatttatagttataggattgatggaacagatataatataaagtaagtaaaaaatcttcatttcaaataaagtatccaaaacaaaaatttgattattgagctttaataacattttttaggtttaggggaggcttaatttggggaactggctattagaaaaaaattatttgaaattgcaatagataatgagctttaaaggtaaaaggttggtgcaaaagtaattacagtttcagtctgtgaatttaaaatcatgtataactaggctcaaacacatctttattaattaaaataggaaccattacaatcaacacattattgccaaggagaagtaaatttattcctgtagcgtaaaaagccatgcttcaggatttgatgaattcttggaaagcattttctacatcttgctggttccaacaactcaaaaactgcaattactttttcactcacctaatattagattagaaaaagatcattatttaaaactgataattgaaaaagagcaaatacaagcattcacaaaatccccccaaaaaagcatctttatagatatttttgttcctgtagatttagactgcatcttctttcattgtcatttcttatgacaattatttgcaataaaaatatcaatttatttatttatttatttatttttgagatggagtttcactgttgttgcccaggttggagtgcagtggcgtgacctcagctccctgtaacttctgcctcccatgtacgagtagttctcttgcctcagcctcctgagtatctgggattacaggcacctgccatcacacctggctaaaaatatgaagttagaaaaaaaaaagtttggtcattctgctaaagtggtggtgtacattttgagttgtcattttttaaatttttttctccagcttctcaaattgtcattagcaatgtcatataaatttgtaaatttttaagataattgacagctttgtgaacacccctatcaagttccttctctctttctctctctctctctctctctctctctatatatatatatatatatacatacacacacacacacatatatctttctatatatattgtatatatatactatatatatacatatatatctttctagatatatatagtgtgtatgtatgtgtgtgtgtgtgtatgtgtgtgtgtgtgtatatatatatatatatacatatatatatatatatatatatgtatatatctttcaaaatatttcaaagccaggcatggtagctcatgcctgtaattcaaacatgttgggaggctgaggcaggatgattgcttgagatcaggggtttgagaccagcctgggcaacatagcaaaaccctgttgctacaaaaaataaaataaaattagctggacatggtggggtgcctgtagtcccagctactcaggagactgaggtgggaggatcacttgaacctattacttcgaggctacagcgagctataatggtgccattgccctgcagcatgaatgacaaaggcagaatttgtttcagcaacaacaacaacaaaatttcaagttttataatatttgatgtagcccttaattttaaatgctttttaaaatttataacaaatttttctcaccttataatagcatataaaaagttttatgttacctttgttgatgttagtgtattttgtcaaatgagcaaaaggtacatttgaatgaaggtattcatataagttactacttggattatcaaaaaaagccaagcagctattctgtttgctatttatctttttctcttaataaatcccttgtttggtattatttaaaacaagggccaaatattttatgccaatttctttgcatattgcatgtgatattttctcctatgactctggggttggatagtggtgacacagaccatgttgcctgcaaagcctaaaataaagacagaaaaattatttttgacagaaaattaagttcatgatgtaagataattttgtggtaatttttgttataatttgttctcaatgttaaaataatttctgttaattttattgcttatctttatttgttgtgtcattttctattaattttgcatctaaatattatctctatacttttataaattaatgttagtctgacaaaaaaaatagccttcatttagggcctaatcaggagtttgaacttctcaattatatttaaatcaaacattccaaaacatatgttcacattacagtatataagtgctttataaaatgtatttccttcagtaaaacaataaattttgagtatataattgtgtatgatacattatgaagtagaagacaactctttggatgaggtgttgaattaaatacattccttgcaattttatacatctgattgttgcaagcattctccacaaattaacttgtggtggtgtacatgacaaagcttttttctttacaacacaggacacagatgttgggcctcatatgacttgttcctatcattatgcaacctcacactgtgtaattcatgtagcaatgctgtatagactggcaggtagacagaggagcaatttcaacattactaggctttaggggaagtgtgatggagaggaagcaggaataatacaatggttatagccagtcatgcttaactatattacttttgcaagttttatgaaaatacctgctatgagaagacactgcaagagctcctcccagggcctttaaccgactgtgtaagtgaggggcttaagcttcattttcttcataataggttcatctttgcatatcaggatacatagaaggaaagataaaacaattttgaaagccaatcaaagcatatataaagcctagatgggcacatattttttattgtgacattaagatagataggataaatgaaattgtcaagatacatgcaagcttctgccccagggcatttcccctatacggaaacagacctcagatcgcactcttccagcagtcttatcccctgatgtctctgaactacatcggtacttcagattctatttttatagttctttgcttttgccacaacctctcgtctgatttctccacgttgcctggtaaacctctatggtcctgaggttttgactctgatctgaaaactgtccctcttctgcaggtcttttttccatcaccatccttttcaaagctgctaatttagacaaatttcctgaggttctagtggaagtggggctacaaatacccttgcattatttagtcataattatttctgggaagaaatctaaatttcttgttttgttttctcagttatatcacaatgcatttgttgaattgaaattgtgatcttcaagcctcgttttcctaatttgtcccttaaagaagggaataggccaatgttctcatggtgccattgctttgatgttgaggcacttacagacctgatccaggactcttaacatttctccctgttcaaggtccattatgtggtgcagagccatggtgaaggatatgagcacaaagctctgtgggttttgttttcctttgtttttgtctttttaatctgtaaattgattcttgctaatcacttgaggaaaacaatgacataataatactatgtgcgaagaatttagcaaaaattggtgctcatctgtcaggaaatgattaatatgattccaaggatgaaatgtggaagcattaacaagagaaacaataacaacagtgatttttgccttaggtatcagaggccccaaaatacaaatttcctaaatccattagaaaaataattgccttaatatgaaaacatgtgcatctaacaactttctgaaataattatattatctgaaagtacatgtagatggtctggctttctttaaagatgtttataaaaattcaagataaatggttaataaccttctatccttgggaatcctaattttgccattctttatgcagacaattacttttctttctttttttataatactttaagttctgggatacatgtgcaggtttgttacataggtatacacatgccacagtggtttgctgcacccattaacccgccatctacattaggtatttctcctaatgctctccctccccttgccccccaccaccaacaggcaccgatgtgtgatcttcccctctctgtgtccgtgtgttctcagtgtttaattaccacttatgagtgagaatatgtggtgtttgttttctgttcttgtgttaatttgctgagaatgatggtttccacctttatccatgtccctgcaaaggacatgaactcattcttttctatggctgcataatattccatggtgtatatgtgccacattttttttagccagtctatcattgatggggatctgggctggttccaagtctttgctattgtggatagtgctgcaataaacagacttgtgcatgtgtctttagagtagaatgatttataatcctttgggcatatacctagtcatgggattgctgggtctaatggtatttctggttctagatccctgaataattgccacactgtcttccacaatggttgaactaatttacgctcccaccaacagtgtaaaagtgttcctatttctccacatcctctccagcatctgttgtttcctgactttttaataatcacctttctaactggcgtgagatggtatctcatcgtggttttgatttgcatttctgtaatgaccaatgattatgagctttttttcatatgtttgttggccacataaatgtccgcttttgagaagtgtctgttcatatccttcacccactttttgatgggcttgtttgattttttcttgtaaatttgcttaagttccttgtagattctggatattagccctttgtcagatggatagattgcagaatttttctcccattctacaggttgcctgttcactctgatgatagtttattttgctgtgcacaagctctttagtttaattagatcccatttgtcaattttggcttttgtggccattgcttttggtgttttacatatgaagagtttgcccatgtctatattctgaatggtattgcctaggttttcttctagggtttttatggttttaggtcttatatttaagtccttaatccatcttgagttaatttttgtataaggtgtgaggaaggggtccagtttcggttttctgcatatggctagctaattttcccaacaccatttattaaatagggaatgctttccccattgcttgtttttatcaggtttgtcaaagatccgatggttgtagatgtgtgacattatttctgaggcatctgtttgttccattggtctatatgtctgttttgttaccagtaccatgctgttttggttactgtagccttgtaagataatttgaagtcaggtagtgtgatttctccagctttgttctttttgcataggattgtcttgactatacgggctcttttttgtttccatataaaatttaaaatagtttttctaattctgtgaagaaagtcaatggtagcttgatggggatatcatttaatctgtaagttactttgggcagtatggccattttcgcgatattgattcttcctatccatgagcatggaatgtttttacatcatcctgataccaaaacctggcagagacataacaaaagaaaatttcaggccagtatccctgatgaacatcgacacaaaaatcctcaataaaatactggcaaaccgaatacagcagcacattaaaaacttatccgccatgatgaagacagcttcatccctgggatgcaaggctggttcaacatacacaaatcaatagacataatccatcacataaacagaaccaatgagaaaagctacatgataatctcaatagatgctgaaaaggccttcgataaaatttaacacctcttcatgctaaaaactctcaataaactaggtattgttggaacatatctcaaaataataagagctatttatgacagacccacagccaatatcatactgaatgggcaaaagttggaagcattccatttgaaaactggcacaagacaagtatgccctctctcaccactcctattcaacagagtattggaagttctggccagggcaatcaggcaaggaaagaaataaaatgtattcaaaaaggaaaagaggaagtcaaattgtctctgtttgcagataatatgattgtatgtttaggaaaccccatcgcctcagccacaaatctcctgaagctgataagcaacttcggcgaagtctcaggatataaaatcaatgtgcaaaaatcacaagcattcctatacaccaataatagacaaacaaagagccaaatcatgagtgaactcccattcacaattgctacacagaaaataaaatacctaagaatacaacttacaagggatgtgaaggacctctttaaggagaactacaaaccacagctcaaggaaataagaaaggacttttcttacatttctaaaggcacataagatcacagagacagaagatgtccagtagatttattttcattcctctagtacaaattttttatagacagaatcataggaatttctgaacctaaaaatattaatcttcatgccacctatttaaaggaaatgcaagcacatgtttattgtaagtgacagtcctctgagatgatagttgatctgtgttcatggcttaagattattatattcagtgagaatgaaattacttctattgaaatcttggaagtaaatgaacagatcatagaatattctagctctcaaggctggtctcagcaagacaatatctgggtagaaaaaacttgatggatagtcaaggatattttagatctgagtaatcaatagcaggtgatggagaaaaagagccatataataagtggtcttataagcatttttgctgctcaagaagtaccagccacaaagaaccaatactattttaaggattaaagttaccaaactatagtagaatgtatgtgtacttaggaatcacatatgtatcatttagtgtgtatgtcactagttctgcaacttgtagtttaaactagttttctcatgtttaacgagatgataaaaaaaactaactcagaagattgtagtataaataaaaagcgatgacatctcgttttacataaattattgcatttgtcattcattcagtaaatgctagctatttttacttttctggaaactagggaaaataacttctatataggtttgtaacgaattccaattacgaaattcgaaataagcataaaacaatacctcttgcatcatatataatcaaacattaaattaccttttgaacaaaaatctttgtttattaattttactggcccccaaatggctatgaacttgttgaaaatggagatatcacattcatctttttattccccatttctagtagagtacctgagacaaagctagcaaatgccgactgattgaacaattccagctctgttattaaaatcatcatataacacaaacttgtcaatggaaaagttaactttcagataccaaaaaaagggaaataagctattgcaaataataatcaggtaaaaaaatatttattctgtttcagcatagtgttataaatattgaaatgtaaattaaaggcagtagggcacacctatatcttgtttctagtttttgctgatagctgtatataatcaactattattgctttgataccaccatataacgtgggttataagattttcagataaaagcaactcttatttcatttgtttttcttgaattactccatataggaagaggctttggaatcgtatttcttgctttgaaattttatttcttgcatttatatgcctttgcaataaaatcgtgttaacttataatctctcacgcaatggtttctcctagtgtttaataaaatggtattaagggtaactgctactattttttctaaaattagaaggtaacattgaatggacacacagcagatacatgttacattctgaaatgtatgctttgctggagcagaatgaatgcaatcaatgtaatggaaatgctgcactaatggctcattaaacatggaaagtatgcatagatgaaaaaagtctgtgcatatgtttcagttcactgaaggaagcaatgaactataatgtggaaagaaaaggaaacatacttctttacgtaaatattcttacttctggaaaagaattgttgaatcagtcaggaatttgacagcaagatttcaactattggagcagacaactttatattgtaattgatggatctggtggacttttaaatattttttttccctattctgtgctttttcacattgtttctatatctttttgtttttttgcaaagttctttaattgatcaatattttcttttgtgatatgtgttttattgctcacaagaaaaaaatttctctatttaaatgttatactctcttacactttctttcaaactgtcacttataccactgcaattcaccccaaattattttagtatatgatgtgaaatccaagtctagctttacttttttcacctttattcaattgtcccagaaacatttatcaattattccacatttcttcactgatttgtaatatgccctttgtcttaaaccatgcaaagctccccagcatcaatagaaagagagaggaagtagatgataaccttttgcagtgggaaacaaaaaagatattttaaaactcttgtttgtgtttggaactgtcacctcctatgacatgtcaaacaaccttatttggcattggatagtgtaagtaattttttgccctgacaaaatatatttaggtacccacttgagcaaaacttataatatagatttaatcatatattcactgttatcatcgacttcattgtgttcttctacctctgcctgatgcacctcttgattattcagcattgttgccaagcatttgctgttagtagctgataacattcatcttcttttgctaaatatttctcatatacaagaagatttaagactgtttatccctgtagttggaagatttttcctctaaaagctgtttatacttttcctagcacgaagacctgcttatatgccacacaagtgtctcttaaaaagttagtcactcaatgccctgctaataggagtgaaaaagacactagaaacaaaaatcttttctaaccagaaaaccacttttgtataaattttgagctccttgcaccacagtgactacagtgtgcctcactaaggtaaacatagaaaatggtatcatttattgtttcaaattaatagggtaattgtaaatatgataagtttatcgaagatattacagaagtatacattttaagacaaccctagaaataattcttttaagagcatgttacaattattattttaaaatgcattactcctaccctaattttagttggaagagatgtatgaaaattacaatgattgtactgcatagaatatgtcatttttgtttgattttttaattagcagtttaatttgtgcagtgtcgaatataagagataattctgataggtttgtcatcacagagtctctggcagttaacatgaatacaaaatattaaatgtattacttaccgcagtaaacggtcactagtcagtaggttgataattcgcatcttgtagaacactggccatgactgatggatttttatcctttcttattatgtatacgttttttttcattaatagtgttccccctccaagtcagtttttatattcaatcctagcacaaatgattttaaaaatgaaagagatgaaggagatcattagattctagcagaggaaaagttgtaatacaagttggtttagaaccaaagtgctttctaactttcccatttgtttgttttttgttttatgtttagacttggtattaaaaaatgaagatgtaaacaattcagttaggaaaccttcagagatattctgcactgaccttcattagagtttgtgtagtgcatgaccgtggtaatatcaaatggttgcgtaagtatctacaaggccctttttcaaaaaagccatcaagttgcatctctctaattattgcaaatatcttgtttactcctatttattcactacatcacttgaagtttcctcttgaatctgagcatgtcctgtaggtctaccttagaagaaaggaaaagtgctgtcttccacattgggtttcagctgggcttacagccaagtgtacattgcaatttgcaattatctccttttcctgcttgtgctggcaaagagagggaaaattttaaatatactctctgtgaaaagagtgtgagatcagaaaacagacagtattatgaatacttaatgtatttcctactcaggacaatttccagcacttttcttttgggatttaggcttctgtgtataatatccccttgaaaactgaagaagtacaagtctccttgcttgtaagcgactaaatggctgacattctggatgcatgttttcatagactattgtgttttgagtaaatataaatgggatcactggataaatggatttggaagagtaacgaaacaagaatagcatgggggaattatctcacaggaacattaaacttaaggggatttaactgtattcccattaagagaaaaagattaaaataaaatatgtacagccacgtgtcatttagtgacagggataccttttgagaactgcgtccttaggagatttctcatcatgtgagcatcatcatgaacagtcatgtgtttctgaacaaccggggtatgttccaagaaatgtgtcattaggcaattttgtcatagtgtaaatatcacagagggtacttaaacagacctagatggtatagccccctacacacttagactatatggtatatcctatttttcctaggctataaaaattttcagcatgttactgtagtgaatactgtgggtaaatgtaacacaatggaagtattaatatatctaagcatatctaaatatagaaaatgtaatgcattgtcctaaaatgttaggatagctatgacttcaccaggtgatagaaatttttcagttcccctataatctatggaatcaccatcatataggcagtgtgtccttgactgcaacgttatgtggcatatgactgtacatctatgtaagttgcatagaccattttagtctccatttcactctgtgagaatgtatcctaaacggtaaatgcaattaagttttaaaaacatgttgcaagcatacacaaaagcatagagtaattgtgcaaattattttaaagttttccaggccatagatgaaaaggtaaagttcattgcttaggtagccagggaaaaggagagtgatagaaacaatggcagtcttggggtagacagtgaaatactgagagcctttgacagtcattgaaaaagaattggagcccgttctccatgtcgtgcttatttcagattgcatgcctgtatcaaaacatctcatgtactccataaaaatacacacctactatgtacccacagaaatgaaaaattaattagaacaatgaacaaagaataatggatttatatgggtgtacataaatccaagtgtgtaatagtttatacacatggacttatcaagaatgataattctttatcattcatgataaatgaaacaatctttatcattctaaatcaatgaaactatcaagaatgatttagatgtacagaatttatagtgaggcatgaccattagaatctagccagaatatagcgtacaatttcactatattaacatattcttgaaattgtctattcatttggtttctactggatggtacaattagagatgaattagggagggacaagaaactagcatttactgggtctctaacatgtgccaaaggcgaatggcacctcaggaaggtgcagctgcctttacgtgacatagggaagaaaacatttagaaaatgatatttgatcttccttgagaaatacaaatagaacctatccagatggaggaaggcagtgagcaatagcatgtttgagaacatacttttgttctcacacatcatgtaccaaacacagaagaaaatgacgcatctaaaattttttttaaaactacgctgatgcttttttttcttcacaacacatttttatggttttttttttttttttttttttttgagacggagtctcactctgttgcccaggttggagtgcagtggcacaatctcagctcactgcaagctctgcctccagggttcatgccattctcctgcctcagcctcccgagtagctgggactacaggcacccgccacaacgcccggctaattttttgtatttttagtggagacggggtttcaccatgttagccaggatggtgtcgatctcctgacctcgtgatccgcctgcctcggcctcccaaagtgctgggattacaggtgtgagccaccacggccggcccatttttatgtcttttaagctccaagttttcttagctattttcatctgtcatatatagcctcaatatattgttgcctggcacatagtaggcatccaattaaaattaattgaatgcatgactgaaacaagagtttctcttcattatgattcttaatttaagcttaaatttagaaatcctcttcttatcatttttcttagtttaactcaacactaataagattgtcgtttctatcatattctgtgtctttccccatgatttccatagctctttgaattaggataatgacttttttattttattttattttatttatttatttattttgagatgtagtcttgctctgtcgcccaggctggagtgcagtggcgccatctcggctcactgcaacctccgccttccaggttcaagcgattctcctgcctcagcctgccgagtaactgggactacaggcacccaccaccacgcctggctaatttttgtatttttagtacagacagcgtttcaccatattggccaggctggtttcaaactcccgacattgtgatctgtccgcctcggcctcccaaagtgagccaccgcgccaggcctaggatcatgacttttataacctgtagcgagaaaagatgcaaatctttctcttattggtatgattctgctcaaactcagatacacaatctagagtcaagatgacaccgtaaaattattttttttaaaaaagaaagaagcctgggcatggtggctcacatctgtaatcccagcacttcgggaggctgaggtgtgtggatcacttgaggtcaggagttcgagaccagcctgaccaaaatggtgaaaccctgcctctactaaaaatacaaaaattacccaggcatggtggcagacacctgtaatcccagctacttgggaggctgaggcagaagactcacttgaacccgagaggtagtggttgcagtgagctgagatcataccactgcactccagcctgggcatcacagcgagtctcaaaaaaaaaaaaaaaaaaaagaaagaaataagaatacgaactgcaatcacatttccaggctgattgtaaaataggaacagcacacttgagccaaagcaaaggtttcaagaaggataaggtcaaatgcacagaatatgggacttagattgtcaagctgaggttaaagtcagtaattattggagagacctagggattccaactttagactaggagcatctaggctgtcataagtaagaagagagcaggggctttaaaacttggctgtcacaggtagcatttcttttccccttgaccctggggcacaggttgtccactcgcaaatgttttcgtgtcacctgacactcaccttctcttctcgccagtcttgcaggccacaccttactcctaccacatcttgccctaggttttccttttcttgcactgaaagttctcctaacttatgccatcctactggggaaaaaaataagtttctttttctccctgctacataactacattacaacacttaataatcccattcaggtccaaaatgcacatctttctctttgcaaatagttactatactttctttaaacattcttattacttattttgagaatgtttctattttctcagttttagcatttcatgagtctttgacagctgggtctcagagagaggccagttaggaattggacaatcgtcttaagcaggctctgggtttcctgtacttttctgtgcagtgcctgtgctgattaaactatgacctgcagtttttctttttacggagttcatagtggtcatttgaaatatgatgtggcattcagaaaaattactctttctcctgcagtttctgtgaatatattttacactgcagcaattgtcatacaaggcatataaggatttattcaaaaatttatcaacaatctgagatgcattggtaagaattacaatgaaaatattagttgttctttatatcactgcaaacaatagacaaatccttacatgcaagaaaacttgctatgatgtttcaatattgtaatttcagccaatctaaggctaaggttctccaaagtttaaatatggtatttttttttccttttagaaaatccccatacatttaatagcccagttataaacatactgcccatgtaggtctcctttacttgtgacctctagctgtgagagaatccttaggttccagagaccagtagttcactgtgtgctaaaggacatgctttagctactcctttgctactccttttgaattctttctccttttctaagtgggcagctctcacccgctcattctctgggctttgcatttagaatgattggtcttccccactattattttagacaattacatttatcatgagaaattaatccttgagggatcaatgatgcgtgcttttctctggctcacaggaacaaaactattattcattttccacttgacataaagtgacccgtgaacccatttacattttcattcccctgctggcagtaccagtgaagccctttgtcagttatcagctagtagtgacccctgcaggcacagccaccactcagcccagggaggactgcttccggggcaggtcccctaggtgccaataaagaatgcaaccattagcccacatgtagggacctaaataacgctggtcagggtcttgggtctacctatgtgaagcaaacaggcaaatattaacaattttgctgtgacctgtatttgagtgataaaggtgtaattcgaagtgaagaactatgagagctggggcatttgtcattggaacttttccattttctctctaagggtaactttctttcatttttacaccctctaccctgaaagttgtcttcagtcttcagtcactgcccctgtattccatgccattatattatgtcatatattggtgactcctgtccctggaaaatttaatgagaaatgggaacgaaaataatatcgtcatggtggaatgacaggcggctgatattgttgagctagggaatgcttgcaatgctgagcacagccacatgtgccagaaatagggaaatgtatgacacaagacacagtcttgaggtgctcatgagctattaggaagttgcagcatgatctcaccatctgaaaatgaaaaatgaatcattctctggggaatgagctaaatttgactcctgaaatcaccatggtgccagggattacggtctctgaatgtgctacagacttggagtgactaatgagctgcttgaggtcatagagagacttaggcaattaaagacaattaatgcacattatcttgcttaaaacatagaaaatgatactccagttacgcagtggttacttttgtgacctgtttagataactctaaacaccatatttctcctagattttataatcttgttgttcattcagtataatttgttttctaacataaacttgatctttactgttgtgagattcttgagaacagagacactgtatgttatttcttctttatattcccagtgcattaagagcttccaaaacagtagatttttgctaaataagataactgttgaacaaatgaaagaatgagcaactgtagagctgtgttttgtgcattttctttaacacagtctatttttactgctgccgatctttactgttgctgatcaacctgagttgagttcatatttgagtgcaaaattcttcttctgactaagtaaggaatacttgagatgatgcaggattgaaggttcctaagtttatcagtaagggagtaagggagtcagcatattttaacccactttgggtaaaatatgacattgaactaagagacaaaaaactacaatgaaattagttaacatagtttttttgtttgtttgtttgtttgttttttgagacagagtctcgctctgtttccgaggctggagtgcagtggcacgatcttgactcactgcaacctccacctcctgggttcaagcgattctccttcctcagactcctgagtagctgggattacaggcaggcgccaccacatccagctaatttttgtatttttagtagagacagggttttgccatgttggccaggctggtctcgaacccctgacctcacgtgatccacctgcttcggcctcccaaagtgctggcattacagcatgagccatcgcgcctggccaacattatagaattttaaattaaggacatctgaaagataattgagttcaacatttcacattcaccctagactgctctcccaagatcaggagctactggagattttgaaggaaaacaggcctattcctaaaatgtaaaaagtgagcatgaaaattgcatctgatgatgacattcaggagaaacagttagtgtgcctatgcaaggtgatccgtgtgggacagagccaggactattacgaagcacttgatacctcaccacggaggactgatgagaaaattcattataaagagtttggctaccgcgaaatgtaagttgacttctaaataaagaattcaaatgaaataaaaatgatcgacaaaagttgactagaagttctctaaaatatatctatttctaattttatttcatttgataattacctaaattactctgaatcctaccttcaattttacttgtctttgtttgaacagtaattcttttgtctcaaatgtcatgtatctttgcttaatgccatgaaatttagccagtcttaaaaatctttgatagaggaaagaaaaatgtcctaaacatgtgttatttattttacttcctgagtctcaaaatgtgttttcatattgtgcttcaagtgtcatggtttagtttttgccttactcatttttaatatatctcatttaatagattaatattatattcccttgtaacctgcttatttcaagaataaaacacaatgtcttaaatagtaacacaattaattcagatttttttgacagcacgatgtatagtgcctaaatatattcagccagatttaaaacagggcataataagtaaaaaaaaacaaaatttcatagtgttgaaaaatcgatttggtgtttaatatttatttagatttataaaaattgtttcatattgtcccttgttatcactaagcaattaaagcattgctatctgagtagaactgccttggatattgtgtagcttatgaagtttaaatggctcaacactgtaggattctgatttgcaaagaaacagtctgaaagctcatcttcccaggctggaagacactggtttatttatttcactgtattaggcaagacaggatgatttttttttttatgttgagtggatgccttttggaagattagaaaactctgaggaagagggttctgaacaacaagccatctcaatttactgatcaccagcagtggaggcaaaaaatgagaaaatccatgagtttcctcttgatctattaaagtcctatttgtgatccaaatcagaattggaaactttcttcatagccttagtccactgtttctgaattaaaatcacttcatcatggtgttattttgaatactgtgatcttaattaagatccaaaccttagtgaacatttggaaaacaatagaatttgctgcaaagtgttacaaaaacatgcaaaatttctaatcattgtcacttactaatgaagtttatgtttctgtaaaagaatagcctgtaactaagtattctttggggttgtctttaaaactgatttgtttaaatttaaattcccagatgtcttaatagaagacagtaaagtcctaaaacaaaggtattcactgtgttcagctccttaacaccaagtacagatcaatttgttagctgcagtgttggatatcttccagcactaaaactgacaaggtgatattaagataaaatatattacctcctttcagtgttaagatatcttaaacctggaactggactcagaggaacaatttatgtagaaatggttttccatgagtgtagaaatagtttggggcaaatgttaaatttttgaacaaatgtttcctgaatctcctttttatgtacagcaggggttcacaaactctttctgcaaaggaccagatacaagtattgtaggctttatcggtcagccaaacgatgtcagtttctgtctctatattcaaatctgcccttgtggcatgaaagcagccatggacaatacctaagcagatagtcatggctgactgttccaaaaaaaaatgttatttactaaaacaggtgactggccagagttgaccaacccctaatgtagaacattgtgttgagaatcgtttaggaaatgaatttataaaaaaaacaaaacaaaacaaaacaaaaaacagtgctactcccctcctggagcttatcatatgatataaatcaaagaagcttatgcataaatacttaaataataagtaaaacttgaaatgtacaagagaagaaggtgcatgataagagtcatgtaagaacggcaggaaggtggggtccatgtgtacagaggagagggggtgcaatcatttaaaactaaggaagaattgcaggcactcaaagctgtcaagcagtaccctgatggatggagactgccctgtagagaagagagcataatggaaccctgggagagccatgttctttccacccatctcacagtctttgggctgctttgttcttctctaaatgcagagtaactattcatatcactgtcttatagaggaggatgctaggaaccagtgttggacaaattagcagagtcagaactcacattgggtttttcttacttcaaatccctcaggattttgcacaatacattcttgcaggtcattcaggcaaggtgtattaaattgcatttttcttgaatggcgtacactctagcctaactaaacatgggtattttgttgtactaaataggagtaaaggttgaaaattttgggtacaagcagaagttggatggttttgaatgcaaagatgtttgaagtttaggtgggaaatagaagaggacccttaaaagttttaaattatagaataagataattaaaatgatgatttatagagaggtgaatctgctgaaatatccaggctatagaaaaccgttatgtagtgcttgactaaactttattcagagggataatgactaagaattagacacatcatggaaacaggtatgtgaggggtcgcacacttttgagtacaacaggtgtcatttgcaggaatatacacatgaccatggttttgagaaaccttacgctagactagcaagaacttcaatcttccaggtatctcctctaaaatatcattatggttgttcagaggtaacccttggcatcagttctgactctctcatgttctgcttctcttagtgaagtggaagtggatgtcacctttgtggctggacaccacaatttctgctccccatagagctccacagtggtgctccttgagcctctctagttgggtctaataatggaaacgtaaattatttgggattgtcattgtctctgtacgcaacttctactttaagccttatcagtctcactcttactccttctggtcttagtgtaacatgcacagagatgaacaggaagaagtattctggtagcatgattgggaaaattgtctactcatctgtgtatgctttatgaaaggcacaaactctctgagcccaaagggttatcacccatgcctgtacaatatttcccacttagacacacactcttacatgaaaattcatgtataaaatggaattctcctgccagggagcattcactgtgcccaagagctcaggctgtgcccagaaccagctgccgcctttgacgtaggccttagtgtggaaggtgattcaccagtttactcttttaatatctgcaatctggcctccatttagggctgctcaatccaccagatgaatatttatatctttgagctactattgagggtttcatccccagccatttctcctacagacaaatgattcttaggttcctgtgttacacagtatgagcaagtatatatggaggatggggaatgacgaacacaagcatccaattcacaatgcaaatgtactcaggaaaagatgatgcttgattattcattagcagggtttgagcttcagatcaaccagaccatatatcatagcagaaaaaccttttctgtactcctgcctcagcaatatctggattcaatatctagttcagcctaaatctattgtatactaaatagtgtaaaagaggtatttaatagataatttttaaaaagcaaaaccatgatcacacaacgcatggtagccccaaattgtaatttcttggaggtgggacacaggcagccaaaaggaagtgaagcacttggtagaatgtacatgaaacggtgcacagtagttgatgctgcttgggtgaaaggaaggggaaaaatctattgatcacagaagatcaatgtttagtgatctggttttgtgtgtcagataccttactaaacgtttttacattggacctcatttaatcttcatgataggcctatgtgtaacaaattgttgaataacttaaagatgtcaggtggaaaatatgatttcatttgttctttaataatttttattgatgtagactttagtaacattattacatattatgttcatatgcatgtaacctatatatttcctttcaaacaaaactatattcttgaaataaaagttaatactaatcctgtgaagaaagtcattggtagcttgatggggatggcattgaatctataaattaccttgggcagtacggccattttcacgatattgattcttcctacccatgagcatggaatgttcttccatttctttgtatcctgttttatttcattgagaagtggtttgtagttctccttgaagaggtccttcacatcccttgtaagttggattcctaggtattttattctctttgaagcaattgtgaatgggagttcacacatgatttggctctctgtttgtctgctattggtgtataagaaagcttgtgatttttgtacattgattttgtatcctgagactttgctgaagttgcttatcagcttaaggagattttaggctgagacaatggggttttctagatatactatcatgtcatctgcaaacagggacaatttaacttcctcttttcctaattgaataccctttatttccttctcctgcctaattgccctggccagaacttccaacactatgttgaataggagtggtgagagagggcatccctgtcttgtgccagttttcaaagggagtgcttccagtttttgcgcattcagtatgatattggctgtgggtttgtcatagatagctcttattattttgaaatacgtcccatcaatacctaatttattgagagtttttagcatgaagcggtgttgaattttgtcaaaggccttttctgcatctattgagataatcatgtgttttttgtctttggttctgtttatatgctggattacatttattgatttgcatatattgaaccagccttgcatcccagggatgaagcccacttgatcatggtggataagctttttgatgtgctgctggattcggtttgccagtattttattgcggatttttgcatcaatgttcatcaaggatattggtctaaaattctctttttttgttgtgtctctgcctggctttggtatcaggataatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcggagattcaacttcttcctggattagtcttgggagggtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttaattcttctctcttttcttctttattagtcttgctagcagtctatcaattttgttgatcctttcaaaaaaccagttcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttctgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatgtctgatcttttacatttgctgaggagaactttacttccaactatgtggtcaattttggaataggtgtggtgtggtgctgaaaaaaatgtatattctgttgatttggggtggagaggtctgtagatgtctattaggtccgcttggtgcagagctgagttcaattcctgggtatccttgttaactttctgtcttgttgatctgtctaatgttgacagtggggtgttaaagtctcccattattattgtgtgggagtctaagtctctttgtagatcactcaggacttgctttatgaatctgggtgctcttgtattgggtgcatatatatttaggatagttagctcttcttgttgaattaatccctttaccattatgtaatggccttctttgtctcttttgatttttgttggtttaaagtctgttttatcagagactaggattgcaacccctgccttttttttggtttccatttgcttggtagatcttcctccatccttttattttgagcctatgtgtgtttactttaaagttcatatggcaccaaaaaagagcctgcatcgccaagtcaatcctaagccaaaagaacacagctggaggtatcacgctacctgacttcaaactatactacaaggctacagtaatcaaaacagcatggtactggtaccaaaacagagatatagatcaatggaacagaacagagccctcagaaataatgccgcatatctacaactatctgatctttgacaaacttcacaaaaacaaacaatggggaaaggattccctatttaataaatggtgctgggaaaactggctagccatatgtagaaagctgaaactggatcccttccttacaccttatacaaaaattaattcaagatggattaaagacttaaacaatagacctaaaaccataaaaaccctagaagaaaacctagacattaccattcaggacataggcatgggcaaggacttcatgtccaaaacaccaaaagcaatggcaacaaaagacaaaattgacaaatgggatctaattaaaccaaagagcttctgcacagcaaaagaaactaccatcagagtgaacaggcaacctacaaaatcggagaaaattttcacaacctactcatctgacaaagggctactatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcaccatcactgtccattagagaaatgcaaatcaaaaccacagtgagataccatcccacaccagttagaatggcaatcaataaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcctattactgggtatatacccaaaggactgtaaatcatgctgctataaaaacacatgcacacgtatgtttattgcggcactattcacaaaatcaaagacttggaaccaacccaaatgtccaacaatgatagactggattaagaaaatgtggcacatatacaccatggaatactatgcagccataaaaaatgatgcgttcatgtcctttgtagggacatggatgaaattggaaatcatcattctcggtaaactatagcaataacaaaaaaccaaacactgcatattctcactcataggcaggaattgaacaatgagaacacatggacacaggaaggggaacatcacactctgcagactgttgtggggttggagggggagggatagctttaggagatatacctaatgctaaatgacaagttaatgggtgcagcacaccagcatggcacatgtatacatatgtaactaacctgcacattggtcacatgtaccctaaaacttaaagtataattaaaaaaaaagttaatactaaagaaagtcttttttccctaaaatattattgtacaaagagagaactcttaataaatgttgacctctgacagaagcttaatttatcctaaagcatttattaaacatctattgtgtactaaaaattggaaaggctttcttttgaggaaaaaataaaaaggcactatatttgttctcaaacactagcgatatgaataataggtgtctatatctgagaaaaatgcagaggaaatagaagggttatctaagtctatttgggctcgtatagcaaaattccttagaggtggatagcttatcaacaataacaaaaatgaatgtctcacagttctggaagctgggaagtccaaactcaggttgccagcgtagtcaggttctgctgaagaggcttttctagggagggtcctctggtgagggtccttttctgtgcagattgccaactccctgttgcatcctcatatgggagaagtggagaggggtcactctctggcctactataaaaaggcactcattccattcatgagaactctgcctgcccttgtgacttaatcacttcccataagaccccacctgctaatacccccacctgctaatacccatcatggagttttgaactacaatatatgaattttgcattcagaccataataaagagtatatttattgcttatctaacgctctgttttaatcctaagaaatttatatcacgcatctacttcgatgctatagctagactaatacatgttcatcttcgtgcattttcccatatatgctattttacttccatctgtacttgaattttcttagtggcttgggtaaagccttgacatgtacacttgttaaaatggcctcttgatgactgacaagataaccagctacaattaatggtcattgtaatgttgagggggaaaatcatccttgaagatgattagatactaaatgaattagcacacagcatatttaaacacaagtatcaagtcaacaaatatgattttatcaatctttaataattttactaacctttattaatgtatattctagtaatgatactatatactatgtacatatacaggtagcctagtatttcatttaaaataaaattgtattcttgaaattaaaatcaatacagaggaaagcttatttctctgaaatatttacaaaatgcacaaatttttaaatttcaaaatttaacatttgtgttttattttaatgaatacaattttcaagtatgttatatgtacagaatggaatacatagcacaaaagaattatttactatctgtgtatgaacctaaactgcatcaatgaccatataaagcaggtaatataatttaaaataaacaataatgatgtaacaaattttttcatatataaaatgaaaattttggagattaacactgcgtctgcctttgtgggtgatttattccacagagctctttcaattgtttagctgccttgaatcttgtagcttagttataaagagaagtttggaggtaaatgttctgcagcattcaaaaggcttccttgaaagccatttaatgcttgaaaaccttttattaatgtatttgaaaatagtcatgttggattggaatatgagagaaaaactgatttggttgattttcctggctcatcagttttgaggttattgtaactaacacacctcagtcagaggcactaatgaattaaacacacagtgtttgattctgtgctgtctaataccatagcaactggtcacatgtggctatttaaattagaaattcacattaaagtaaaaattcagtttctcagtcacactggttatgtttcgtttctctctctctcttttttaaaggaagttttgctcttgtttctcaggctggagtgcaatggcacgatcccagctcactgcaacatctgcctcccaggttcaagtgattctcctgcctccgcctccttagtagctggaattataggcacgtgctgacatgcccagctaattttgtaattttagtagagacagggtttcaccatgttgaccaggctggtctccaactcctgacctcaggtgatccacccgcctcagcctcccaaagtgctgagattacaggcgtgagccaccgcgcctggcccacactggttatatttcaagcactcaatagatacacatggtttgtggcaactaatggacagtgcagatgtagatggaacagatccattcacactgaaagtactattagccagtattattgtaagatgtacgataacctcctttgcaattttatttagtcaaaagatagtaaatgcagtgtaaagtcattagagaaatattgacttttaaggataattaaaaaccattaggataataaacctatgttaaggttattcctgattaaatcaataccatcatgagacatattccaaagatccactgtgagatgctttatggaaactctaatttctaactaaaaaggcatgatatgtgaacactcatagcttaataaaaattatagttaatatgaatggcagcctgtcatcataaacatggttagtaaatttcctggtatccctctcatattcttcccaattggcatcattcatgaagtttctgtgtgattagttccaactggatttccaaggtgatcccccttttctaaaagaaataatcataatctcttccctttgccacaatgatgacttcatgaatatgaattgagctcaggccccagtcctaccatgaattacattcctcctatgatgccgcttgattcaagggtgtacaagagcttcataaggtcaaaacaaagtgaagtccagcagttttgctttaggatgagggagatagattctcacttttaccggatgctggggtgtgtggactgatacccagaataatcatagttatgttgttgccctgaaaggtgctagcctgaagatgaagacatatagaggacaggggatgagaacatcacacactatcactaaaaatcagttacttgggctgggcagggaggctgaggtgggtggattacctgaggtcaggagttcaagaccagcctggccaacatggtgaaaccccatctctactaaaaattagccaggtgtggtggagggcacctttaatctcagctactcaggaggctgaggcaggagaatcacttgaacctgggaagaggaggttgcagtgagccgagatcatgccattgcactccagcctgggcgacaagagcaaaactccgtcttaaaaaaaaataaaaaataaaaaaataaaaaataaagtcagttacttatttacctttaactatagatgtcaaatttagagttagattttctgttatgtaaagtcaaaattattctgaaactcttaggtatgtgacgacttgtaggcaaagttatctctccaaattggaaattagtaatcttatttaaatagagtcttcacatttagtaaaagcatattgatgttggtacatttaaattgcaaaataaaagaatgacttactctttagaagcaagaataggactgggcacagtggctcacacctgtaatcccagcattttgggaggctgaggagggtggataacttgaactcagtggtttgagaccagcctggccaacatggtgaaatcccatctctactaaaaatacaaaaattagccaggtatggtagcagatacccgtaatcccagctacctggatgagaatcactttaacccaggaggcagaggttgcagtgagcagagattgtctgggtgacagagagagactctatctaaaaaaacaaaacaaagcaaaacaagaatagacagtatattcaccaggtatacgtatattaacttctattaatttaatattttcgcaaatagttgtttgaagtctctggtttaggatagaacagaagtacatattttgggtgatatctgaaaaatggactctgaagggagcacaaggagagagaatccagagtgaataagacagtagctcacggctgggcgcgttggctcatgcctgtaatcccagcagtttgggaggccgaggtggatggatcacctgaagtcaggagttcgagaccaccctggccaacatggcaaaaccccgtctctactaaaaatacaaaaataagctgggcatggtggcaggcacctgtagtcccagatactcaggaggctgaggcaggagaatcgcttgaacctggcagacagaggttaaagtgagccaagatcatgccactgcactccagcctaggcaacagagtgagactctgtctaagaaaaaataataataaacaaaaaaaatagtggctcatgtttcacaggcgcgtaatccacatcactgctgtgcattctgagagtgcaggcgtgaagtatagtcagttcgggattgtaatcagggtccttaactgaaagatctaagggaaactaagatgttttacccctcccaccctagacacacagacaataacagcggtgataaatttcaagatgaaatcacagatgtgctcctccatctcccattctcaaaattaggaaggctttattttgaggtgccagagcacacattaggggacatacaccttcctaggtagacatttcagatattttagagagcatgtgaattaagaacttgaagtcccaaaatagtgtttaaagacatatggtaactagcagaggcatgaaaacgctatttttatcagcaaatcccagggaaggatggggagacagatgatcctgtaagggagctaaatttcttacctttcatggcatagagtcaaccacttaaagtctaatgatgatgagcgaagaaaccggtatgtaattattgaggcatcattgtggacacaaccaggaaaataaaatctgaaaacaggagcccttaaaatacaatttgaaatatggtgtcaagtttgttggagatttgttaattcaagtggtgagttaacctaaaaatatcacagaggccaggtgtgaggtaaaaacacaaactgttttcctgcttctctcgcactacaacagtgggcacagaaggcgtctgtgtgtgggactttctctccatgtaccaagtaagcaaccagttctgcagtggacacaagctgactgtcctccagcccagttgcattctgaccctgtctatctggagagagcctcagatcccacagggtgagggctccatcccacaggcctgccctccacttcccatgccagttgcaagccccaggctcttttacctgtgcttctgactgaccagctgtaagtcagggatcccaccacctcctccttgggtttgattaatttgctagagtggcttacagaactcagggaaagacttatttacattttccagtttattatgaaagatatgacaaaggatacagatgaagagatgtctagggtgaggtatgcaggaaggggcctgaagcttccatgccctctttggggacatcaccctctaggaacctccatgtgttcagctgtccagaagctcttcgaaccctgtcctcttggaccttttatggagattgcattggacaggcatgattgaagcatggagaaatgtcattacacaagaagggtaaggtatagtcctcatagactgggtagcgaaacccggcaaagcctgtctgttctgtctgctctgtcgattcttcttggcctcgctgtgcagtattcttctctcccaggaatggggcaggactcctggaatgggggcctatgaacaacaatcagacaagcagatcagagaatttctttgtagccccctccaggacagaaaggcggaggaagattcctgccctggggagaaaaatgagtggataaaaggaagggaggagaaaggcagagagagtctgttttctgaggtttgctcctgaggtctaaagaaccccaacgttataacaaaggccacaggagttagagccagaacataaatgaaaatacatatataaaaaacataaaataataatgaaaaagggaggaggctactattgtttatgactcaatgtaaaacttgcagagagaaatgagtgaagaataatacttcaatcattcttctgtcttggtgttcacaacatagagacacacacacatatacacacagaatcagaatcagaatgaaggagacataaagataccatatgtgcatagatggacttcctgtaagaatgaatagagaaggaaaggaatagaaatgtaagagaatacaaacagttattccagtagagaatgaaacgatataattattgagtgatcgttcatggagtggttttggaagactctcaggaggagtctcctgtccttgatggcctattagccctttttgccacatgtgaaccctaacactctgaaggtgaaagataataacagacagtgttgagaccagagctaaaattgttgaacacataatcatgacagggtaaattaactatttcactttatcaaatgttttaataaactcttaaataatatgcattgaaaaactggcatttgatgtggaacattctcttagatactatattttataatttttaaatttatgtatgtatttattttggtgagcaactgaaaactgcaattgtcagtgaacttccaagtgaaatgcctttgcgctgtctgagttttagatcttcaaaagctcaaatgagtaatcctgtcaaattacatgggttgatatggaagagagataagtaaataaaactccactataatatttgtgtggtaccacacacatttggcttaaaaataaaaagggattgaagactgtgtaaagaaatggaattttttaaaagataagataggagtaaatatagaaaaggtcttaaatgacttcaggcagtgaagcaaaaagcacattcccttgtttcttcctgtagaatgataccctagaccaggctattagctgtggataggagccctttatagttcagcaaactattaatttatagtttaccctttcagctaagacattgaagctattctttaaaaatttgagataatttgactatttaaaaattcaactacctttgcaaaatcaaaacagatctgttttgtaagaggtttgccatttcagcatctcactgcaagtgataaggtggttcagtgtttaaccaaagatcatggccacttgacccggtcttcaacccagcgctgtgccaggctgcacatggagggcaccagctgagtatcaccagccaaaggactctttcaaatgacaccagaaaagcctgtcctgttcagaaaaatgacatttccaggagttggaataatgctaaactacatggtctgtaaagtttcctctaagtaatatctaaggcactgtgagtctagccttgggaacatatttgtcaaaagactatttaagaaggggagatttttcagtcctcattgtgttctctctctccctctctctagttaaatgtatatattcatcaggtatttgaactcattttgctaaacatgggacacagaattaataggcattaatattttgtccaaatttagataataagatcatatatatataatatatatatttaactctcctcttgctactttactaaatatatatttattaatagaaatgagtattacatgttaatctctgaagatcccaaaataaataagaaagtgtccagcctttcaagtagctctcagtgcattggggaaaatgaatgagaaaagtaagttctactgtagtattaaagcaagagtgtgaataaaattttgttacagttaaacacagagcacttttaaaagtttgagattttgagtaaggttaatttatggtttagctatacctcctgtggaagttctgaagatcttattgattttctacatttggacaaaacattaatgcctattaattctgagtcccatgtttagcaaagtgagtccaaacacctgagaatcaagtgactttcccccagtattgattttgttagtggtaacaatttgaagatctccttaactcttctgttctcccagttgtctttactctaaatgttgccctgtgtatttaaaacctctaaaatccacattccttcccatagcctgttccctttctacttccctggcctcgtcttatactgtgtatgatagccacactggccgccttctatttttacaaagattgctgtctcttttatacttgatgtttccctcttcctagaatactactccctccaatctttatatggctggctccttcttattatccagatcgcatctcaaattgtctccacagagagtgctttattgatactcaaactaaataacaacacccttgccccacaattacatttcattccatgtttttccattattacaatttaaggtttcacagcctttgtgtctgtaattattttatttgtttatcatctggtttcctctaattgaaataggtccgtgaaagcagagtgtgatctctccaatcctgtatctccaacactatgagcagtgttgagccataagtccaaaaaaatgtttgttgaaggaagaaatacttctagttcccacaaattatgcaaagggtaaagtaaaatctgtctaaatattatgagggcaccaagagggttacatttgtaaaaagaagaaataataactatgtaagctgaaaactctgtattactgactccttataagaggactataaaagagaagagtaaaatataaatcagatgatgaaggtataatattttcacatgttttgttaatatttagtttaacctaagtcatgttaggttggtgcaaaataagtgtggctttgacattacttttaatggctaaactgcaattacttttgcaccaacctgataaatgtaacctttttccaggtggatgtcctagttggttagtgatgctttttccattagatttgaagtcattgacgttgtccaggaaaagaaaagagcccaggacagagtttttggaggatatgaacaggcagaggaggatgaaaatgaaaagccagaaagattaataggaaatcaggtggatagggggatgtggtaatgttggtgggggttacctatgtagttctagtaaagaaaccaaaaggcaaaacagaatgtcagaagggggcaagtgatcaacactattaatgctatgaaaaagctaatacaggtaaggactgagctgtatgtgtcggtgaaactcaagctgctgtaacacataagtccttgattgacaatggtttgcccagtggaaggttgattctcaggagcagaacagtccaggtaatcttggttggcagggagctttgtaataattggagaccaggtgtggaatctgtttttgagtggctataacaggatacccaacactgggtaatttataatgaaaagagatttaatgggctctgcagactgtacaggaagtgtggtacaaacatctgtttctgctgatgtcctcaagtagtttccagtcatggcagaaggggaaggagaaacagatgtgtcacgtggcaagagaggaagcaaggtgggaggtgccatgctctttgaaacaaccagatctagcatgaactgacctatcaccaaggcaactgcgctaaactattcatgatcccttgtaatccaaacacctaccaccaggccccgcctccaacacggaattacatttccacatgagattctgaggagacaaacatcaaaattatatcatcgggttccttccttcttttggcctcactctattttagggttccagagtcccctacattcagctactgagtgtggaaaacagacaagagaagtcacaactgctttttctaccccttagcctagaaattatacacatcacttctactcatattccctaggcacaaggtcccatggttatgcaaaggagccaaaaaatgtagttggtagaagcagctatttcttggatatagatttatattatggaaggagaagcagaaataatgatgggcagtgacccatcttctgtgatactttagaaatttgtgcaactaagtcatttttcacttcataaatattgattgatctcctaaaaatataggactacatggtaatttgtgtctgctcccaaagagttataacttattggaagaaataagatttacaaatgaattatggtaattcaaagatatttctgatttattcgtgtaaattttgggatagaaaaatagatgagaacagtagaaaacaagtacatgtgtattactaacccagcaaaaatataaaccctttttactgctacattttgccattttcagaataaacttgcataaattctcctcattcttagctcaaactgtgctgctgattggattgaactacttgtatatgaatgtatcttggtgtgatacgtagcccattaaaaacctagtatggatttcttaactaaaatcctgtattcctaatttacgttgatttccatttttttaatctcaaagtaatatttcagttttattattgggtaaacaatgtgtattctggcttagaacactttaaagttatttcagaagaggtcacaggggaagaaagatccagaaaagtggaatattttcatgaatcattaagttaataactttggaggaggaaggtatgtctagaaaaggcttaaaacaaaacgattagacttactttaaatatttttatttcaaattaagtagatgaagatggtataaatcaggagttagcaaaccttatattgaaaagggccggacagtgaatactttaggatttgcagaacgcatataatcttcgtcacaaatattcaattctgccattacagcatgaaagcagacatcagagacagggcaaaagcataaaccagcgagtgttaatgtatttcaatagaagtttattaattgacactggactttgaatttcatacaattttcctacattatataacattattctttctttgattttccctcaccatttaaacatgtaaatggaccatgcaaaaacaggtggtgggctggtttggcccataggctataacccctggtatatagagccattaacataaaaatacaatttaaagctaatttagaaaattttacccaaagctgtgtaaattataacacattaattattatattctacatactcatttagggtggaactttataaaatatcttttaaaaatatataatatataagatcatgttatgtactacaaaattttaacacaaacattaacaccccattctttgtgtttttttgagaagtttttgttgttacttacacgaatgaagctataggaaattatcctaggtcagttcaacagaggagacattttcagtcttgctcatgtttagcactctttgaaagtcttgatgctcaattagtcaattagtagccgccagatggagaagggtatttcttcacaggaacacgtgttgctatgtgtgtgattaagagggtgaaagatgctgttgtgtgtcagacctctctgtgttccttttagatgtcactagctcaatcaccaagggcaatggaccataagatacttatgtatcttctgcttggcttcatgcttgatgcctctgatcagactcagtgtttcatttccagtatcacagatgacagagtaaaatgcaaaatgtgttgctgcacatgtcaaaaggtccagagaagaaaagacagctctacttttgcatttggattaacagcaattgaaaataaatgcccatttccaattctttgatattgtttaaatttatatgtttgatatctgtttgttattatctacacgtatccagggattatttgcctaagctgcaaaattggaaaaaaaagtacagatttagaaaatatgctgccaatggcttaattcagattcattgttaaaccacaatattaaagtacactgttaacataatgtacactgatagttttgtttgataattacctacttgaaatagtagactgataaattgtcccaattggagaagaccttcaaccatctatgccaaccttctagactgcaattattaattaatcatttctggaacaaaagctcctaaaaatggcttttaaaattgtgttttctgctgaaagattctgctgaatggaagtgggagtgtgaagcctaggaaagaatatattcatttcatgtttttgattagctctgaaattttatttaccctcttacctagaggaagagtgccagtgtatattccctaatcctctgctcaggaaattcaacactttctgcaatttgtacttgaaaaaaggtacacaattttagaaaacatagacaaaaaaaacagaacaaaaccaaacaaaaggcaattattgatgtgaagcaaaaagtattaatgcactaaagagttgcttcaggatgcctcccttgccccatcgctacacacaactaccctacaaacgccaagattcaaatgtgatactctcttccatattacatttgaatcttctttttccaggaaaagcagagtatgtatgggtgtacccatagtaagcatgagggcttccattgtttttccatttggcgagttgaaaaacaagtgtgctgcattctcctgtctgttacggtacagatatcttcattggagcactatttgtgaagcacacagttttcaagtcttctagagcaaatttgtttgtcaccatcagaagggctggaaataaaaatatgtttgcaattgacatagtgcaggaactggttaacagcttcaaagaatttataaagaatatttgtctctgaaatgttataaatacccatggtgaaaaagacctacttagaagatgttttctttaatattcattgtgttttaccaaatacagtgaggatatatgagcaattagaaacatgtgcctgcaggttggctcttgctttctttgcagacctactgcccttcttgttcttcctctccatcattttcattgccttgttaagatttatctggccaggcgcggtggctcatgcctgtaatcccagcactttgggaggctgaggtgggtggctcaactgaggtcgggagttcgagaccagcctgatcaacatgaagaaaccccatctctactaaaaatacaaaattagtcgggtgtggtgggacacgcctgtaatcccagctactcgggaggctgaggcaggagaattgcttgaatcctggaggctgaggttgtggtgagccaagattgtgccactgcaatccagcctgggcaacaagagcaaaaccccatctcaaaaaaaaaaaaaaaaaaaagatttcttaacctgcttttccctccgttgcttttgcctgtttccctttcctagttttcactttatttttttttctctctcctattctgttttttattctttgttccactttatattctcccttggtgtgaagaatggctgcagttttagtcatggctataagacaatgtcattttagagagctaatgtgtcctgtcattgaaaggatgagatgataacagaagtaagaggggctggtgtcctacatctccacggcaaggatttcgcccttctcccaatggtgtggttcattgaaatagctccacatcctcattaagtttatttttatagtatttctgtctctaatattttttccccatggaaagattaggttttctttttgagtccttctggctctcccattgtccctgtttgctggcagtggaaatgctataaatcagtattgaggtctggcaattttgcatgccgtcagctaaacataatgctgttgaaattcaagcacagttctttttaagtagacatttaattttagtagaatttgcatttgacagtttgaattcatgtgtttcagcatctgagtgaaatagccctctctgagttctaatggaatgaatttagtgaaattaaccttttgtcacaaaaacacactatcctaggcaaaagttttcacactgttttcagtcagttctatgtagttataatagaatgaatcttcctaatttaagtcatagaatgataaaagcagtgatgaaaagagaatgtacacctaggagtccttaattactctgtgaagtgccagcaataagtatgggacattgacgtgaaactccagttcattacatcaaaaaaaatattaatggtgagatgtctgacactgacaaaatacctagacataacaaagtgcttgtggaaaatgcttgaatttttttttttttttttttttttttttttgagacagtcttgctctgtctcccaggctgaagtgcagtggtgcagtctcggctcactgcaagctccgcctcctgggttcatgccattctcctgcctcagcctcccaagtagctgggactacaggcgcctgccaccatgcccggctaatttttttttgtatttttagtagagacggagtttcaccatgttagccaggatggtctcgatctcctgacctcgtgatccactcgccttggcctcccaaagtgctaggattacaggcgtaagccactgaatttttaaatttactcttaatatgtattcttgagctaattaatgagaaaattcaaacaatcatattcagtaaagttaaccatcaacacagtcgataagtttttcacaaatattctcccttttctttgaaataaagaaaccagatatagaaataagaagtttctattttaaatatttaatatttcttctggacaacattaaagctattaaacaatgccattggccaactatcaattgttaagtgtgtccaaaccctggcattcaatttttttccaagacacttaaacatttaaagtctgtttttaaaatcttaattatttttattaaaaaaggatttttttaagaaaaaatgattttttggtaacactttaggttgcaatttttttaattttaattttttttatttccataggttattgggaaacaggtggtatttggttacatgagtaacttctttagtggtgatttgtgagattttggtgcacccataacccaagtagtatacactgtactcaatatgtcgtcttttatccctcacccctctcccaccctttctccatgagtccctaaagtccgttgtgtcattctatgcctttgcattctcatagcttagctctcacttatgagagagaacatatgatgtttggttttccattcccgagttacttcacttagaagaatagtctccaatatcgtccaggttgctgtgaatgccattaattcattcctttttatggctgagcagtattccatcatatatatgtacaccgcagtttctttatccactcattgattaatggacatttgggttggttccatatttttgcaattgcaaattgtgatgctataaacatttttgtgcaagtatctttttcatttagtgactcatttacctctgggtagatgcctagtagtggaattgctggatcaaatggtagttctacttttaattattcaaggaatctcctcactgttttccacagtggttgtacttgtttacattcccgctagcagtgtagaagtgttccctcttcactccatccacgccaacatctatgattttttgattttttgattatggccattcttgtaggagtaggtggtattgctttgtggttttgatttgcgtttgatttgcatttccctaattattagtgatgttgagcattttttcatatatttgttggccatttatacgcctttgagaattgtttattgaccttagcccactctttgataggattgttcgtttttttctaggctgccactgttttaataaaatagtttttttcttttttactagatcattcttatgattcagttttactagcatttggcaattagcaattattgtatataaataaagttgtttcgttctctgaagaacctgcagagaaccctcgtctggagaaaaattctgtcaggtctaatatttgttaagttcttaacaaagaacctggaacacaggcaaagctcaataattttattaaattcaaactgcattcttgctggtgagcaaaaccagtgtctaaggacttacatgctacatagttctttgatgccaacattagatatagaatgattagcaaatacgttccaaaatgcttaattcttgtgaaaaatgtttcaaggtatacttgaggtattatccttttttgtaaaggccatttgagatgacaatttttgaactactttattttaaaagcatttattattaagaaattcattaattagtactcactgcaccctacttttagtcctgcataatgcacctgtatttttgtactaaaaggtaaatacaaataaatgaaaatgaaaatattgaactctaagtatgtcaggattcctatagacatttcacactctgagattatgcaaattatgataatcatgttaataaagatttggatgaattaattgttattcaaaatggattagtttgcaaaacttcaaattagtctaaaatggagagatttttctggcctcattctatcttcttcgcaggtctttgaagacagctgtgtagtatagttactgtgatgatattgtcacagaaataagttgaagcattttgtgtattttgtgtactaccaatgcctaaataactaactgaaaaatgtatatatattcatagaaagataccagggacaagtggaaagttacttaacaatgatgtgaactttgacatacttaaactctttcggtctcaaatttattgttcagtacaatggttaacaataaggtggttataactattttataatcatcctataacaattgagtgactgtaaaaatgaaataagataaactttcattaaagaacctagcatagtataatgacaggtacataaaagtcctcaagttttaattcttatccaaattcccgtaactctatttccaaggcctcaattttctcacgaaaggcctcttactttctgaaattctatgatttagtttttagttcaattaatattttagcaaatgagtaagttaatgaattaatatatttcctttagagtttactttctaatgcacatgctgttatggtcctatatgaggaaatgtcttttaatgtgcaatattaaaattcacggtcacataaaatgaataaagttttaatgtagaatataacatttttgaattctagaattcaacttaccagagaaagaaaatcttagaaaacctggttaaaatggcttttgataagcacattgaatataaaaacagggtatttatatatatatatggatatgttttctatcttattttcagatcgtaattagccactatataggttttgtccttcacagaggtagaaaaaatacatttaatcacttccaaaaatctgtttgagtcctgatagcctgatatcctttgaaatgcttaaactttgtatttggtatgattcgagatttcactaaattctctattgtccccacgaaaatgacttatttgggtagggggtatttcttatcttgttggaagctttataaaggatcagttattgtatctttgagctgatgaaatagtttaacactgctcaaaacttgtccaagatgctgatatgtatcttcagttagaccatttgaacacatgactaatacacagaccaaagagaacattgtttaaaagaaatcttatcaagaatcatgtaatagatcttaggctatttggatttcctcacaggaaaatagaagcaaaggcagtgacagcaatactcaaagtaggaattgagctctgctccatgtggataatgacaacatctgcatctgttgtgaacttgctcccaaatcggagccctgtgtttttcagcttcctgatgaacatttctactttgtactgcacaatcgcctcactgttaacattctgaaatccactcatttttcctctccatatttctttcttacacacctgttcttcttgtctgccagatgtttgctttatatcacaattgtcttttccccctaatcttggcaactcagcatcatctttgattctgttactgattgggtctgagatggagataagtatgcaggaggtttagcgtgtaggagcatgtaggggtgctcttgggatcactacctgtggaaaggaagggaaggaaagaaagaaggattgggaagagataaaacttgggatgcaatgtactcttaccaaagcctagagctgacctcgttagcagttttaaatctaggatgtcccttcagtactggcctgtgttggggtgatgggactgaggcttttgtctccactttggccagtcactggatacaggttgccccaggaaacaagtagtagatgtaggacaaagtgactttttctcagccaaagaaatttggctaaaagggctaagaagttcttcagtcaggaagagatcttgtcagcacataacagtatccactggagactcctttaacacaaacaaacaaacaaacccacaaaaagctattatacatgatcagatcttgttttcttcatgattttaaatttccaaatctcatctcttgctgcccaaccaccaatctaggttaggagcttatagtgcctaacataggcacttatgaataagtaggacctcctaaatcagatctatccaatccatcccttatccatcgcatttttcaacctcatgaaatgcttccatgagcccataattagcccgtttagtaactcgttggctctccattggcaacagaataaaatgcatttcttagcttatgattcaagaacaaccactgtctgtctaaataatataggtgttgtcaccccaatcttccaagcacatgttttgctttgttagtgccattgattttttttttttacatttaacacctaaaataaaagatctacttggcttatatggaaatcaaatatcacatagttatctggtcatatttacagggatattatgtccaataagccatatttacctacaattttacttaggtcctgtagagaaaaataaaaaataaaaaaaaaggggttgaggatttgcaagaggacatagttacacagatctaatgtacaatgatatttgaacttctgtggacttgttcttatgagtaacatcttccattttaattaaggtcagatgaaaactttggcattatccatgctgagtcctgagtctcaatcattcaatgaatgagttgctaggacacttagttcaattagctatgaggtatacacatggacagaatgttttacaaaacttggccctactgacttgagactctcacatgtattacaaaaacaagtgtatccccatggaggtctgactgtatatctgccttgtaagatcatggaatgttagttgtgtttaagttcctttaaccttctttctcaatttataccttgtttaccactaaaaatagacacctagccttagttgttttggttttaagattgtttcatttatgagtatatactattctgtggctgatttttttttctccctgatttctcttcccctgagttccaagtacttttcacaaagaaaaccttgttcataattaaacatttcttacctcaggcttggtttcagagagaaaccattcaatcaaaagagtgatggaattctgtcactctgatgttatttttagaagttgtttgggttttgattgacacatgttttgtggtctgtgtgtatgttgctggggataatttaattttaagacattaataagaaaagctcattgactcagtcaaagggaaaatgactttttgaagtcaccacacagttttaagaagggatcatagacaaggagaaaacggccaaggaaactttggtttagctggagtgtcgtgccatagtcagaggattctgggggaaatagaaagccctaagaattagttcatatgtgaaaccccacctgccattttggttgatttcctttcttatatcctataggcaaatttccagtgcctactggtttcagtttaataggtgagaaaagcataacacacataaataaggtttaaaaaacttttaaaggctcaagaaagaactaaatgcattcagaaaaaaagaaaaaattagatctagcccagtctgaaaggaaaaataatggcagttgaaatgttgaaatttgattgaaagatttgagatatagtatttgaaatatagtattctaaatcatttaatttagaataccattaatttttaaatattttgggattgaaatcagttcataatgtagctagagaatttaattcaaatgtaaaggaaggacacctgatatgcacttcaatatcattaaatttagaggtcagaatgaaggcagaagaagagagaaatgattctgcaggaccaacccatgtggtaacatatttatgcagaccaccccaacatgatcggaatattactgccacagtggggcacaccttgaaatatgatgaaatgtttcaaggttgttaaataagaaagaagttacgaacagaattgttttcatcaaattttcactgtgtaataacacattgtaaaaccaatataggagtggatttacaaattctgggcatacataagcctctctgatgacttagctaagctggttttgaaaagaaagtgcaacataatggtgaagattattcaattttgctcgtggaaacaattgggcacataatgaatcaagaaaaatgctgagatcgttgaacaacaaaactcaacacgatcattttttgaaatcttccgtgttgttatggtgatttgtgtatttagaacttaacaatgtgaatggcatgaagaataagtgattatgcattgctgaatgcctttacaagagttcgctaagaagaaattactgctttatcataaatgtattgttactgcttgaatgatgatagctgtatatttgtccctttactcactcagcaaacactattcatttcaaggttttggtgttacatcaagcaaaagactccaactgagaaatggtactattatatacacacacatctcccttggagggtttctgctatgaatcaatattatggaatgactgtgtagcataaacagtacatagcatcttttagataatcatatttagaaacagaaatccttttatatgtgtattgttatagtttcatgttaaagaaggtaaaaatcagcagaactacttttaaaaaaaatcttagagtaatacctccttcccatgagcgttagtaaagataggaaagatgatcgttttatgctacatattttcctattgccaggtcaagtattataaaatttaatacatattgttgtaggactttctccttagttcagctggaaacagtgttcttgtcacacaaccatgaaaaattaggctcacagacactttgaagggtgagaatggcagggtttattgggtaaaaacaaataaaaaggaacagggactctcagcaaagccggagtcctgctaccaggtttcctgcctcatagattgaatcccaggttccaccccagaacaggagaggccaggctcctgccccctgcaaatggaaagaacttaccggctccaccccattctccctgtacacaggccaattagagtttctctggggacccctttgtacctggctgtctcaatatgaagaaaaagtagtcatactaagattttttttttctagaaccaactatctaacataactgtcaataattagaaacaaaactgtacaaaaatacttattatataaatttttaaataaatccttgctaggactttgctctctgaaatttgaaagtatattttaaaacaaattaatgctttatctccttcctaggaatgtattcctcacattgtaacaagttgataaccagaattataattgctagtgaatccgttttcttattctattctctgctcacacatgttttaagatgccatgcggttaccagcagtgaatccgtatgggtctgcagcaacctcagttcttgcctcctccaaagaaagaattcaaccaaggaggcagaacgcaggagagatggaggcaatagagcatgagtaaaagtttatcataaaagctttagcgaaggaatgaaaggaaataaaatacacttggaagaaggccaagcgggtgacttgagagatcaagtgccctatttgaccttctgacttggggttggcatatttctagggtcttgcatctcttctcccctgattcttgccttggggtgggctgtctgcatgtgcagtgggctgctggcacttgggaggtgagcaagtgcagtgtgtttactggacttgtatgcgtgctcaggtgaggcattcttcccttacaaatcgaatgaacctagaaggtcatataacaagtaaactctgccattttgcttcttaaagctcatgcttgagtccactccctgaactcctgctgattgcatcaccagtttcaggttttttttctatctattgggagactgccttttcctggcgctggctgtgaccagttattattttagagaggcagttaacaaccacctgcccatcacctgatggtggcccgacattcctggtggagagcagggagagctccctcctgccccgctcaagccttgttactacctactgtaacagtgctatatagattgtcatgatgattttacaggtgtatacgtatccccaaattcatgaagttgtacatattaaatatgtacagcttttttaataccttattaaagtggtgtaaaaatagtcgtgctacatatgactattttgtcatggccactactgtcatcttgagcattgcaaattagttattctagatgaaacaaaaaaggcttgcctttgacaatttctcaacatgtttagtattttccaggttcaaccaataccactttgaactgctctaaatcaagtaagccagaatgtgtctggcagctgaactactgtgaacctaataaatattatcatcattttctattgctaatcaggagttgcattttaggcaatgcaaagtgggtggggtactcactttctgtagatgattcatggaactaacaatacataatacagcatcaaattaaaaacttatttaagtccaatctatgtgaaatagaacaagtgacaaatgacataggttactagtagtaagtggtaagggagctgggttttgatttttttttaaacaaattcttttctaatgcatttattgcaggcacagagcaagtaatcttaccatcagagtttttgtactgcactctattttccttttcaagaaaggaatttcatgaattgttttaagcacagctgagtgttattgttcctattttgtgcattactgttaaagttctcatttccttttcaaatgtgtaattttaaagacgtgatgaattcttaagaataattttatgatgattaggaaagcaatttttcgagctatatacaatttaaattttatagtgacaatcatgaaaaatagaaatacactttgcagcaaatttgcgaaattatttctgctaaatgagtgactcacataaagcaatttgggtttgttttattttattttttgtcattacatcatgcagctgttttcctctatcccaagaatgtaactagtgattgtaggatcatttcaaatactcaattgtaaaatggcagttttacatatctgtggtgatttaaaactctcacacacatgggtgttaatggaaactagttactttatgagtattaagataatttattaatcttaaatataacttttctcattgtggatgtttttggtgaacaaatacattacttcacagttatttttgtggtgagaacacttaatatcaactctctttgtgttttttaagaatacaacatgattattatctatggttgccatactatacaatagatctctcctcctatttagctgtaattatgtttcatttgagaacatctccacattcttccctccaaaccactccagcctctgttaaccaccattctattctctacttctatgagatcatttgttttttgattctacatatgagtgagatcatgtgacatttttctttgtgtgcctagcttatgtcactaaacatactgtcctccagattgattcgatttgtgataaatgacacgatttccttcatttttatggctgaacagtattccattgtgtatatatactatgttttaaaaatccattcatccattggtaacatttaggttgattccacatcttggctattgtgaatagacgctgtaataaaaatgagagcagatacctcttcaacataatgactttatttcctttggatctataccattaacaaaagtgttagatcatgcggtagttcaatatttaatttattctggaacatccatactattttctataatgactatattaatgtatattcccatcaacagttgataagacttctgttttctccacatccttgccaacacttgttatcttttttctttctgataatagccattctaacaggagtgacataatatctcattttggttttgatttgcattgctgtgatgaataatgatattgaacatttttatatgcctgttagtcctcttttgggaaatgtgtgttaatgtctttgcccattttaaattgagttatttgtattcttgctattgagttgtttcagtttcttatacattttgaatattgacaaaatttaacctacatttatcataaaagcactccatgaatgtatcagatgtgtagttaaccagatgtatagtttgcaaatattttctcccattcagtaggttgtttcttctgtcgattttctcctttgctatgcagaaacatttcagattttggtaattccacttgtctatttttttgcatttgttgtctgtgtttttggaggcatatttaaaacaaaacaaaacaaaacaaaacaaaccttgcccagaccaatgtcatggagttttctcctgttttgtttttgtttttgtttttttttagcagctttatagttttgcatcttatgtttaagtcttgttccatttttaattgattttatatatggtgagaaataaggatttagttttattctctgcatatgtatatccaatttatccaataccatttattaaagagactgttttttcccccattttgtggtcttagtgcctttgtaggaaatcaattggctgtgaaaaagtaaatttatgatttttttttatttctgtgaagaatgtcattggtcctttgatagggatcgaattgcattgtagatgactttaagtagtatagacattttaacaatattactactttcaatctacgaacataaagtcttcctttttatttgtgtcttcttcaatatgtttcaccaatttttcataattttcagcgtagagatctttcacctccctggttaaaatttttggagtatttttttatacctatcaaaaaggagattattttcttgatttctttttcaggtagtttactgttagtgtacagaaacactactgattttgatttttgtgttaatttttatcctgcacctttaataaatgtgtttgttagttccgacaacttttggtggagtctttagagttttctataaaacggatcatgtcagctgcaaacaaggatactttaactttttttttccaatttgaattccttatattacttccttttgcctaattgttctggctaggacttctagtaccatgttaatagaagcggtgaaagcagatgatatggtttggctgtgtccccacccaaatctcatcttgaattgtagcttccgtaattcccacttgttgtgggagggaccccgtggggagataacggaatcataggggtggtttcccccatactgttctcgtggcagtgaataagtctcacaatatctgacagttttataaggggaggctcctttcgcttggctctcattctctctcttgcctgctgccatgtaagaagtgacttttaccttccaccatgattgtgaggcctccccagccacatggaactctgagtccattaaacctctttttctttataaattatccagtctcaggtatatctttatcaacagcgtgaaaacaaactaatacagtggatgtccttgttttgttctagatctcaggggaaaagatttcatctttcccatttaatatgttagttgtgggattttcatatatggactttattatgttgaggtatttgtctatacctaattcatggagtgtttttatgatgaatgcatgttaaattttgtaaaaaggtttcttctgcatctattgaagtgatcatattatttttgttgtccactctgttagtgtgatgtgtcacatttattaattcgcatatggtaagccatcctttcatctctgaggtaaatctaacgtatcacaatgaatgatgttttccatttgctgttgaatttggtttactagtattttgttaaggatttcaaacctatgttcatcaggaatattggccagtagtttgtgttcagatttaattgtatcaggataatgctggcctcatctaatgggtttggaagtatttttttcctgtttcaattttttagaaaaatctgagaattgatattagttctttaaatgtctggtagaattcagcagtgaagccatgaggtcctgggctttttactgatgggagactttttatttctttttaatctccttattcaatattggtctgttcagagattctacttcttcataattcaatcttggtaagttgtgtatgttcagaatttattgatttctcctaggttatccaatttgttggaatataattgttcataatgttctcttatactattttgtatacctatggcattggttgtaatgtctgcttacttgtctctgaatatgtgttgagtattctctttttttcttactctagctaatggtttgtctacttcatttatcaattcaaaaaactaactcagttttgttgatcttttctaaggcttttgtagtctgtattttatttatttttgctctatctttattatttcctcccttccttcttattttagatatgggtttttttctttagtagttctttgagatacaagattaggttgttggagatttttcatatactctgatgtaggcatttattgctataaacttcttttttagaactacttttgctatatcccgcagaatatgttgtgttcccatttatatttgtctgaagaatattttaaatttcatttttaaattttttcattgtcccattgtttgttcagggacatgctttttatttccatttatttgggaattttccaacgttccccctgttattgatttctagttttatgtcactgtggtctgaaaagatacgtgatatgactttaatcttaaacttgtggaggcttgtttgatggtctaatatagcatctatcctggagaatattccctgtgcaagtaagaaggaggtgtattctgcagctgttggatggcttgttcttatgtctgtatacctgctatattcatttagtcagtaggacagtttcaacatgatgtttctatgttgattttcagtctggatgaactatccattgctgaaagtgaggtgatgaagtcgcttactcttagtgtatttcagcctatcgcttccattttattaatatttactttatatatttaggtggtcctatgttgggtgtatatatttataattattatatcatcttatcgaattgactactttataatgacctttttgtctcttttcacagattttggcttaaagtctattttatctgatataactatacctagccttgcactttaatggtttccattccctcatttttagtccatatgtgcccttacctgtgaaactgtctcttgtagtgcatttcaacatataattgagtcatttttttaaattcattcagctattcagtgtcttttcattagagaatttttttattatttatatgtaggaacttactgctgtctttttgttacttgttttctagttgttatacagattcattcttcctttctttcttactgctttcctttgtgattaagtaattttcatgaaaattgttttattctttgctttttctgttagcgtatctgttataggcttttgagttaatgttaccatgaggcttatgaaaatcatcttattgttgtaacaagttattttaacctgataacagcttaagtttgattgcaaaaaaaaaaaaaaagacaaagcaaaagcaaaaatgtttacatttttactcgactcctccctaacagtttgaatttttgatgtcacaatttacatcattttatattgcatatcgattaacaaataattttagttattattattttaataattttgtgtcttaactgtcatattaaaatgtttggttgctacaccatcatagagtaataaaatattctgaatttttgtgtacttacattacagtgagttttgtactttcagtgatttttgttttactcactggtgtcctttcctttcagcttgaagaactccttgtagcattctttgtaaggtggtgactaactctctgcttgtgtttgtctgggaaattatttatttatcttatttctgaaaaacagctttgcagggcatagtattttttgttgacagttttttcccccagcactttgaatatatcatcctgctctctcttagcccgtaagatttttcttcagatgtctgctattggcttattagagctctcgtcatttgtggtttgcttcttcgctcctgctgctttccaaatcctcttttttctttgattttgacagttgcagtataacttgagggtaatcttttttaaattaaatcagaatgaagactttttaccttcctgtaaatatttctatctttctccaagtttggaaagttttctccttcaatttttaaaataatattttacctttaactgtcattgcttttttttgaatgccaatgattattatatttgctcatttaaggttatcccagaaatcctgtaggctttctgcattttctttatttttatttcctttttcccctttgtatattttcaaataacttgtgtatcagtttagagaatcctcttccacttacgaagttcttctgttgatactctctatagatttttaaaatttcatttgttgtaatttttagctctaggatttctgtttgatttaatattattattatttcaatttattatttcctcatcatagtcacaatgttttcttcatacctttagctgtttttctgtatttttttgacatttgttgagcttccttaaaacagttatttttactttatcgtgaggcatttttcatacatctccatcttttcagggttagttgttgccaattacttttgtccctttggtgacttcatgttttcctgattattcttgatttttttggtcatgtgctgatgtctgcatactgtagaagtagatacttattccagtctttgcagtctgcctttgtctatgaatatccttcagtgttaagcctgtccagaggttaagagtgggccacctggtgtgatccttaagcccgtgaccactgcagctattgcagtactagggggtgccctatatcctgaaccaccatggctggtatagtgactggtcagaattttatggatacagagcctgccacaatgcagggctaaaagtccatgaattctataattagtgcggtgctagggtgtgcttgaagcccatagttgctgaggctagtgcagcagtgggtcatgtctaaatcccatgacctctgaggtctgcctgttgtggtaggttatttagaatccaaggctgctatagttggccagtagttatgtgaactagaatttgagtcattcttgcagggcctgggggttcctatcttgcactatggtgggtctaaaggatcaggctacagataccaggctaaaatcagagatcatgcaggtctacctaatgctggtttttactgtggtgggcctggtatttgtgtccaaggcaaagttctacgattgcttacctctctttctcccaagtgaacagtgtctctctctgctctgtgctacctggggttggaggttgggtaacatgggaaatgcaaaaatgtccgttctaccttttttggtgtgtcttttctaattattgtgctatgacaaggtacagtcatcttttacttggttttcgtagctcttgtgagatatttttacctatggatagttgtcgaaattgatgtttcttccggtgggtgatcactggagagtcttaattgacagtcttgctcggccctcctcaggtttgactattcttaatgtcctttttctattgggcacctttaaatggaacacttaaaacagacacgcatcttttaattattttacagatgagtaaaagaatcaaatgtgaatttattcaaggtaataaatattggtttaaagaaattaccatagatcttaatatagagaaaatcataattgtggcttacctataaagaaggcttggtgctgggcattttcttcttcattttttaaattctgtacgtctttccaacacaaatgccttctaaacactgatgatgctgtaattcttatctccagccatgaattcttcataaaatctgagacttatttccaaattcctctagttagaggactctagaaatcttaccaccccatgaggatagttataatgatctgaagtccaggttcccctgtaacaaagcttgtcaggtatttgaaaaaaaagaaaagatgtaacactgaataaaaaagaaacaaaatataaggaaaaaataacttggaataaatagaaattgtacaggggaaggaaagcttaaaaaattaatatttttagatagatccaaataatttatttaaaaatgctataataaatagtgtttggaaattaaaaataagacatggtaaattaaaaatgtaataggagacatttaaaaaaatagtcaatatgtttagagaaataaagttgagaaaggaaatcatccattaagtaaaacaacataaggcaatgtaatagaaatatataataggtagggtaataaagtgtgataacaaatattaaaataatgaaaattatacaaagagaaactttaaaagatgcatttattatataataatttactgtgagctatgtgttttcagaattaaaaataaaaagagaatgtccagccaaatggatgaacatacactcacatagagacatgtaattatgaaacttcagaaccataagagtaaaatgaaggttctgcagcttcctgtggggacaaaaacaacagcaaacagaaaatatatcacatacaaaggatcgaaactcaaaatggctttggactttccaacagcgatactggaagctagaagataatccagttgtgcctatagaattctgaaggagattatctccagtatagaattctatagtgagctaattattaatgagttgttagaatgaacacatacattctcagacaaacaaaacgtcacgaaatttaccccctttactttcatgccaagcaagctactagaggattatttccatccatttgggctgctataacaaaataccataaactatcaataacagaaatttatttctcacagttctgggggtcaagaagtccaagatcaaagtatgagcagattcattgtttggtgagggcttgctttctggctgatagatggtgccttctagctgtgtccttacatgtggaagaatctaacttgctctattgggtctcttcattagggcgctaatcctaatcatgagggcacttaccttagaaccttaacagctcataaactccccacctcccagtatcattatcttgcaggttagggtttcaacaaataaattttgggggacacaaacattcagaacatagcaaggatgttccttccaaaaaaaaaaaaaaaaaaaaaaagaagaagcagcaaactggaaaagaagacaaggatttagaaaaccaaaggactaacagaaaagggttgtatctctagcattatgaggaagagaagtcccagagtgactatctgtcctttcaaacaaagaaatgaataaggaagatattagagggagcataaagagagtgctacataaaaggcaaattaaattctgaggctgacaaaaaatgaaagtcctatattgacagctgtatagcatgactagagcagaatcaattccgatagaactgagttctccatgtaggattgcaagtagattacattatgtgattgatcttgtacgtaattataatgagagactactaaaacataagaataggcaaaccaaccccccccaaaaaagtagcaagttaaaaaggggctataaacaaaaagcgagaaaaaaataattattgtacactacactgataaattttgaataatacttgcaaagttatattaatacaaatatctaatattattaaaccaaaaaaggcaggataactaaactgctatgataaaaaatggggaatagaggaaataacaacgtaagagttaaaatctcaactaaaatcagtcaatagaaaatatttaaaattaataaatcaacaaatagatacgcatgcatattatttagagatatatataagatatatatacaagaatgccacagtaaagagtggataatggtgattttgagagataaagcaaagaaatgtctacttttgttaggaaccgtttaatgccatttaactggttgggtgcagtggctcatgtctgtaagcccagagttacgggaggctgagtgaggtggaaggactgtttgaggctgggagttcaagaccagtctggactaatatagtgagcccccatatttacaaataattttttaaaaattatccaggcatgatggtgcatatctgtagtcctagctactcaggtggctgaggcagaaagattccttaagcacaggaattaaaaattactgtgagctatgtttatgccattgcactttagcctgagtgacagagaccctgtctcagaaatttcaaaatatcatttaactttgtttttgcttgttaattaggtacaataacaatacattcaaaataagaatatatttccatgatatttggcgaggaaatatatttggttagatgtacaaaaaactattgaagaataaaatcgatgaattcaataatattaaaacttaaaactcatataccaaaaaaaaaaaaaaagaaaaagaaaaacggtaacaaaaataacaagaaaactacaggaagaaaatgaagccattacatagattgggataatataattgaaacttaaacaacaaatgaaatatttattttcagaatatacaaagttctaaaaataaaccagaaaataattgaccttgtagaaaaatgagcaattggtcataacagaagaaaaaattcaaatgtccaataaatataggaaaatttacaaatgcaaattaaacaaaaacatgacacttcttattggctatataggtaaaaatataaatttccggaataccaaatatttactggcaagtggggaagagaaattttgcctcatatactacttaaaagtctaggttggtacaatcacttttacaaatagttaaactgtcatcgtatggcggagttgaaagttaatattcctgataagataaatgttcctgataagagaatatttacactaacagaatcttagtttaattcacatatactgatctaattactgcaactcacacttttattattgcctttattttgtagatgagaaattgaagcatacagaattaattagcttctccaaggctacctagctagttttgcttgtgttaaaacgaatcaactagataatatggaatatactggaaaatatattgttgagtaagaagtaaaaacaaattgttgagagcacataacagtgataaatgtataaagttttaaaacacaaaataaagttttatgtgtatttaaataatacagtgacttattccaaaatcagaaaagcacagatgtggaagacacccaccaaactgaagatagtattggtctctccggaggcaggatcaaaatatcaggaagagcttcaaagctatgtcatattttattttttaaaatgatccaaaatatatggtaagattcaaatacttgttaaatctgggaggtgtgacatagttatttttgtattattctctctgattttctatccacgggaataggaatatttcataactttaaaaagggaaatgatgtaatcggtaacattgttgtctcctctttaatctcacagatattcctaggagcaacccttgttattttttatgatccatacacaataaccaatattttaaatatattatacaaaagtattgtagagaaggaaaaataatttttttctctaccctactgggttcctagctggaatagacccctgcaacaaaggacaaatgaagaacataaaagcaaaaagaagtttattaacttgtatacctcatttacatgtgggagatacccagaaaaatgagtaagtcaaagacatggcttagagattaggcctaaataccaccttcaactgaaacaaagaaagaaggatatgggccagggtgcagtgatggtaaggtgaccaagaaaagtatggtaatccatgataaattctattatgcagacttaaaccagtgccttctccactgaaaagagtctctggtgatttagttatccttttcttctgggtactgaaaggaagccacccttgcaaatggaacattcctttagagataagtatttctctttaaaaagagtaacttctacttcattttcagagcttctttgttgtctgcagtttctcaaaataatcagctcaaaataatccttatggagacatattttggggtatcctatcctggtttcctacagtatcatgtatcttattgtaggagggggatgatagtctttttattttacttattttagattctttttcttctactcatcatagagatggctctacccatctggctggagccctgtaaattacactggaaaaagacagattaacaagaaactaaaactaaatagaaatttattaacatgcacaccatgcacatgcatgtatataggagtacccagtaatgagtaatccaaaggggtagttagaatataggcttatataacatcttaggctcaaaaaagaaaaaagcgttttgggcttctgggcaaggggtactagttgggaaagtggctaggagaagtatactaaacaagggttgttttagtgaggtttgttatacagatttatgtaggtgtcttctcaatccataagatttaagagttatccattgcctgatatgggaaagggagatatcttttacaaatagaaatctcctttatacatgtaaatttattttacaaaatgaaaatttatgccctgtttttagagcttttctggtgtctgccattcctcaggggcctttagctcaaaataatgcatatgctaaagaggtgtattttggggttgcatattatgatacctttcaatataaatacaagaattaaatagatgacataaaatgcatattcagaaaaaaagaagattcctcctctcccacaagaaaaattaaatttattttctctaaactaaatcttttctgtattttgagttttaaagtgtgtgataataaggaaaatttatgagtataaaatatcttcatatacacttctagtcatcttccttttagactgtgagaacatgaggctcctgtcattttactatgtttccttgtaatgcttttgttactggggagtatggggtccttggttcctgtcttcttggaggaaagaattctgccaagtgacacacaggggcaattcagcaatggcaatgtttatttaaaggaaaaagtacatgctgaaagccgagtcagggtgggctgctccagaatgagatgcattgactgacactggggaaccccctttatgagagttttacatgaatatttacaaatgggcataaagaggtgttaccagtaagcacattttgggaggtctcaaaacatgtgtactacactagtacatatgtcgcatgtttcattagtattttaaatccccactcatgggtgtgttttttactattatgatgagcaaaatgttacctttagggtgagccaagtcaaaatgcacatgctcgctactggggaaagtccctattgaagtgatttttctgctagggccaggtaagtctcagtgagggctggataagcctaaccataagcccagatgtggctactgttaattctgattgctctaaccacagagcataaattttctttttgcattgattccaagtggtgcaaggtatttagagcttctggggctttctttcctgctatctgtctgtctatctacctgtctatctagctacctactctaatgcttttcttcatacaaataaatgcagtaacttgtcatgaaattttaaaaaataagaaaaaagccaccttttgtataattatagttatattattgaatttcattaacttcatcagattaatgtaaattaaatatctgagcatatttaatttctagtttcttggttgtgggttgtgggctgtgtaagtaagaaaaaagccacctttttttctgggtttcctataacctgactagaattactaaggtatctataattaatgtaaattcagctttcataaaattaaatatcttaaaatatctgagcatatttaatttctagtttcttggttgtgggttgtgtaagtacttcagaactatctttagtcacaccaacaaaagagaaaatcatactcactctccaataagtaaattacaaaaaaaatacttatttccttaatagcttttgacataataaaatacactaaaataaaataaatgaacttctctccctaatcatcaatggaaagaaaagctaagcttctaataaaataagtgcaagttcattttcctgtttcttgttaaaattatttaatatgacaagtgtctaatacattattgcatatcaacacaatattatccactaaggaaacacctaatttggggtggccccacgttttcaatagacccaattattcaacccctaacattctattcattatttttttaggatccattagcaaaatattctaaactatcatttgtagtaacaataaggaaagaccgtgacttgttaatcctggttataagcgtattgaatgacctactcaaggaaggaggagcagaaaataatgagaaccagctggttctaaatcttccattatttctaatatataaggagagaatgaactataatttttatggtcttcatctgacaatacttcaagaagaggtcgcttactatggtgattcattttcaaaatttacactttagtttactatacctggtgtgggaaccagtttgcttcaagaaattataattttaggaaatggaaaaaatatttttcctctattcatattaggtttattggttgggtccctgcaaattagactgaagaaagattagttaacaaaagaaaacaaacaaaataaaaaaaacaggagttttttaagacatacattgtgcatacacacgtaagtacgccgtcataagtaactcaaaggattggttacaatgtaggcttatatagcattctgacaaaaataattttatagataagcagcaaaacaaaagaaaaggactttgaacctctgcggccagcaaattgtggaaaggcaaatatgtagggagactaatggtagataaagcctagttcgtaaggtttatttatctggactttttctctgtaccttgttgtctcgggtgataaagtggttattctttttctgatacaaaaattgagaaagaggagagagacatagccttcacaaagagaagttgttttgtgtgttcaggtagatagggggagggcagagaggtcttctggtgtttggatttttttttttttcagttgccttaagttcaaaatatttttaatgctcaattgggctattttggggtaatattactccaaagcttttcattaaaaaatagaaaaattatacaaatgccttccaaagatctagattatgcatatatagaaaacacaaacacatacacaaacatacatataagtagcgcaagtttccatgtcaagtgtacctatctgtctttactttgttaaatgtatcacctcttgctaacatgtatgtcttactatttagtagtgggagtaattcaaaaacactaaggtcaatgttctgataatcatccgatttttccccattctgcttataaaacatcagatttataaaaacctaatgtctgattgagaaaaggactcatgaacaaaaatcaagccatataatgtctaacaaaattggtggttattatatggtagcagtttgacaaccgacagttttcatccagacttagtccgatatgtgcatttaccttggctgtagaactgtgttgtttatttcacttggagttgtgctgaattaataatttcccttcaaaagggtatcattagtagccagtggacttttcaagctgtttattttgaatttgcaattcaattgaatgaaaggaaatacatataaatatggatcatttcagataaaaataaggcttttgttttagtagggaaaatatagaatagcttaactcaacatctagtagaatatttatcaatctagttcccaacattaatgagagcttcaactagcagcaaattctatagacttccttctacctagagcttaagagataagtcatcagcttaaattttggagtgtgactgtcacaatgtttcaacaaaatcagtcagattctttagaagctacacagttttcacagttattaatgtatatagatgtatatgaaaatacatactgatgtaaatttctatgtagctctgcccagtggaagagcctaggagcaacaatgctccagtatgctccagtatcattgaacacaccaggcgtctatatcttggttcttttttttttttttttttttgagacaaagtattgctccatcaaccaggctggagtgcagtggcatgatctgggctcactgcaacttccacttcccgggttgaagtgattcttccacctcggcctcccgagtagctgggattacaggcatgcgcaaccacgccaagctgatttttgtatttttaatagagacacggtttccccatgttggccaggctggtcttgaactcctgacctcaggtgatccattcacctcagcctcccaaagtgctgggattacagacgtgagccaccattcctggcctagatcttggttctttagtatcatttttgattaatggattatgccttcttgaaaaaaatgatgaattttggttctttagtatcatttttgattaatggattatgccttcttgaaaaaaatgatgacttttggggctgaaacaagacacgtatatatgaatctaaaatatctatttgtgccagaaagtaaggaaataccagaggatgatggtaacctggcagaagtacatagcagtgagtttagaggggataccattggccaaatctggaacaatttgagcatcaaactatgtagtgatactaccgtattataactcactgaataaaataggaatctttcagttcatatagttatggacaaagacatgagtaaataaatggagagaagagaaagctttttcttgtagaagagtaccaactagtcagcgcagaagtaatgatggaatcaggaaatcaaaatatagcaatcattgtagtgataatcaatgctgctaagaaatatactggctgagaaaactagcaggttaaaatgtgatagggaatggaatatttacatcttctaaatgtacctccccccgccccaaataattcttaattgtaaagggaagaaatggtaccttccacagtagagaagctggcatgttatcaaagttagtatcaccataaatggaacaaattaatatcctgccccatctgaggaagcttcaccaccgtgtatttctgccaaaatacctaccctgaatttcatcctgaggaatcaaaagacaaacccaaattgatgcattgtcaatgggagaactggcctgtgatatagaactatcaaggctgggtgtgatggcttacacctgtactccctgccctttgggaggctgaggcaggtggatcacctgaggtcatcagttcaggaccattttggacaacatcatgaaaccccgtctctactaaaaatacaaaaattagcttgacgtggtgacacatgcctataatcccaggtacttggaaggctaaggtaggagaatcacttgaacctgggaggcgaggcgggggttgcaatgagccaagattgcaccacttcactccagcctggacaactgaatgacactccatctcaaaaaaaaaaaaaaaaaaaaaaaaaaggaacaaggttgtgagggtaacagaaagaaaagcaactgttctggattgaaagaggcataaaaactaaatgtgacatgggattctgaactggatccttttggtattgttggggctcagaaaaccatactcaaaagtgaaggcctcagaagcagcctcggaagcaaagtttatctctggcctcctattccgagccactcattctcctctgagacaagccatggaaactagaattcatctccccagagcaggtcttaggaaccagaagccctttttcccaaagccagccatacaagctaaaaatattgttgtcatattttcctgtcttatctgggtaagagctggccatagagaaagtctctgaccttcctcgtttgatggcagccattccagaaagtgtccagcaccatattcaggaggaaggaacaccgcatagagaggccaagaagaatccagataagcctggctgggtttccccacctgggtctactagaattagaccagatccttttgtctaatcacagttctgcatgcctgtccattcttcattgaacctaagcataaaaatggatacttttccctgttcctttaattcttcatcctgagggctcccatgttatgtaaaaccataatgaaatatatttgtgatgcttttctcttgttaatctgtattttgttataggaatgtcagtcatgacctttatgatggggtgggaaggagtcaccccttttctgctccaatattataaaaaatggtggtgccataattggggaactctaaataagctttgtgcattagatagtagtaatagatgtaaaaaccctcattctaaggtttgtcatggttatataagagcatattcttgtttgtagaaattacagagtaaaatactggggatgatgaaaagtcagccagcagcttacttttaagtgattcagaaggaataaaatgtgcttcatagtattcttaaaatttttgctgtaagtttaaaattgtctgaaaaagagaaaaatgagaaagtaattaggaagatgaagtagtacttttgaaaacgtactaatattaaggagtaaattttaatttgaaattgaacctaaatagtagttctaattgtggtcacaacttgaaagtaaatgacagattaattttagagagttttaattctatataaaatttaaaagttgatcagtatgaaacttgagaattgtgatatttgaggctagtcaagaatcaatgaaactaatttaggcttagaaatatctttgagaagttgtcatgccaaagcttttgaaaacataatttgtaattagattgaatgttttgatttggatataaaactgacttagaaataataagagcagagcaagtgaaagagctccccaatcctgcccaaaactatgtagataaataaataaatactgaggccttttgggacctgctagtattgcagccagtgtaaacacagatgtgtagtgatgtggaaaaatgtgtttaaaattgaatctccaagttgacaactcttatagatgataaaaatcaaattaatggatcaacatttaccaaagttcttttaaaaccattttgaccccccaaaatgacaaacaagcataatccaaatatgtgtagaaaaataattcaatgtgttttcttgaataatagtttattaaatattaattatatgatagcaagtatgttgtagaatgattaaaattaattttctaagtcattggtcctatttttgaatagattcaaatagatcaaggtaattttgacagaacgggtcaaccattttgctagtcactgagagatgtccctggaatgatggtttgcagttgtggtgtactaaatattgaggggtgtactagacctggagggaagtgaaggaaatattaaaacttccatttgtctttggaatgagaactaaacttttagctttgtgctaagtggtttcttcagtaaaatatcaatattttatttatgtttttcttacattaagcatccattttagctaacctcacaaaatatactgtccctaaaaactcagtcttcatgtaaacactttgataccagctgttcttccatctaaaattattttcttcctcctcattgccttttcttcctgaagatgatcctgtcttcaggatctagttctctttctgccttttcatggaacattgctacaatacttcatccgtgtccgtctatcccctctgaatatttacagcatatgttcttagcataatttattcagaaagtaatcatcattgtcttgtgacatataaggaagtattttcttaccgtttaactctatctatacttctgcaatacaatttgaggttcttgaaagaggaatcctgtcttattcctctttgggataaggggaatattggtagacccaatgtctaccatgacccaaatacagtgctaagagccgggaacagaaatctaattatttctctcttccgacatgctttgtgtttatatgaagttgtggacaagttaatgaaagatgcaaggtaaaaatatgaatgcacattagctaatttgtctatattagaagcacagtgagttatgaaatggaaaaagggatgtttgtggcatgagatcagagctctaacaatgcctctccacaaggagacttccagtgatgtttttctggcactcagcccttagatatcattgaattaattcactaaagcaatctgtatgctgtctatgctcattttaatgttaattattctgtgttccaaaacaaatgtattttctcagcaggaattaaaatttcaggaatataacataaaaaaccctgtatcgtttgaatttttcataggtttttttctaattaaaacatatattgttaagtgcatgtttgcttttctaaaataacacctagtaatttgtaatacattggtttgttctatgagtgtggtttatgatggtctaccttttatccactggtgtaatatcttacgttttatcagtaaccatggaaatgtttagtacatcatccaacaataaataaataggctaacttcccagaaatgaaagtaaataattatttatttaattcaaagtagagaacatagcatggatttaaaaatcttatgtaagatccaataatccaaatatttaatattttctctttggtttaacataatgttcaaatccgaaagcctgctttgctcaccaacacctcccacccaacaaaactgccaacatgccaaaccaagtggattgatttaacagcaacattaagctcccctgccagtgtttggtggaaaggcggttaatccggagtgaaaggcctcaaatcttgccaacaggaaacaaaaaaataaagaagaggccatctgtaatacatactcatagttagtcagtccctggagattcttcagctctttgtctgcagcattaagaaacacatgctaatatgttattctcttttgttgactgctctaattgagatgcctgacaaattaatacagaatattaagattattaatgccaaatggaaaaagaagccttactacaaaatgtcatataaaagttatttgtaaacgctaaggaattaatttcttaaattatttcagcaaatgttaactttaattgtgctcaatgaatgtttatggatgcttttgacacagtggtttttttttttttcttttttccctcagagtatatttttaggcagtttaggaaacaaaagataaatgaatgattagttgtttagtttgtctgattcaaggcatagattggatttaaaagagcaggaagcatgagctcttgaagtggctctgggcacactgccccaatttctggatctcattggtaaaatggacagagtagggttactgggggaactgtgataatataaagttcttagcacctgtctgacatttcttatttttagttatattgtattgttttgtcttcaaatgcagcagataatcattttttattctatagctaacatgctggcatcatccaaaaaagtgacttctattttttttaattaccattttgaaaacaccatgccctataacatctaaagacgcatttactttagtgagtgggaataatgataatataatcccatggcttattcataaaagagaaccttggagatgctgtggtaatgagcaggtggtaacaattcttgattatttatacatttttgaggatataatgggattgagtcattgaactgctgttgtatcaatatgtaaatttcacacatcagttttttttaaagctgttttcttttgaatttaagaagggtaaaaacacaccagaaatattttaaaagagaggcctcagatatctcttaaactatcatgttctgttcacattcgtcaccatcaaacttatattctatctctaatatatcctacacattggcacatggctcccaggaagtagtgtctacagtaagaaccgagaaggtaatatacttgctctcaatttcttccttcttaggaatgacaggcaaaataactgtcacttctgtcaagtagcaatagatactattatgaagtatatcgtgtggcaaaatctctgctttaactgagtactttaaaagtacttacctaattttcattgcttgagtactgtgctcacccctttgggaacaccagaaatttgataattttctatctgagttctaggagattgaaagctgtgcgacttttcaaaaactttctgacacatgagtgctaatttgagcagaatttagctagctctcacaagtgatgaaagcgcggaagaaccagtgagcactgtcagtcttttaatctagtatctgattgcttgtctaactgtcattggtgaaaagcaaatatctttgttcttcttctgagttcaagccggatgtgctcctgtatttagcatgacaggaaatctcaaacggcaaagaattacatggatttaaggaatctgatattcctgtattcaaatctcccctcttgttcatgatagagtcttctgtagaaaatctataaaatagcaagaattaaaaacatactataaagtatatgtttggcttatcagaaatccatacaaactactttttctcagggcctcttaataagaactggttccatttgatgagtgagttgcaaactcttgaaggcatattgacagatggtttcatctgaacaaactgattttcttgatttgccaaagtgcctaaaaattagttttcaaatttttgaattatatttaaggcattttgcttctgagaggtgacttttgacagacccatattgcttcttataagaaacttaggtgaataaggcacaaaatagtttctagaattacttaattgtttttcaaggaaaaatggggctcaaagtgaatgggccacagggaagttacagctggatcctgtagagatcactgagaaaggtctactccctaggtcactgtgcacagaaagacaggcctactgtgattccacagagaaaaatgtgtccggccaatggacactctgagcacataaactactgaaggaagagagattgatgatttgggatgcttgagaaaaattttcctgcatttattcttaataatatgttagtaatttaagctagtaaaaaaaaaaaaagaaatcaatgtaaaggatttcctgacttctcttttctactgcaaataaagtaggttgatacatttaaaaagggctattctccttctccttcaggtcctttatttctgcttcttcttctgtcatattttattttttttctcacgtcttttcccaccatcctcccagttgtcttccttcccaacatcgccatttatttcatattatattcttcagcattacacacacgttatttaactggaaagtataataactacagccatttcttaaaatacaacattaatgggatgtaatttgttataacatgccatttgaaaatactgcatttttttactttagtaggatttctctactagcaattgtaattattgtattgtgatgtttcctatgtatgctataatatatgctataactgcctaccttacctacagatgaaaactctacaaaatggtttctaaaagtatctcaagtaaaatttgattttgtttcaaattacctttaaatttttaacattcttaacttcttttttaaaaattacaatttttcataatgccaaagataggaaatagtgagtaaaggacagtaaactgatttatttagcgagtaaagaacagtaaacttatttttactaaacaactctttttacaatacactctcaagtctaaatttcaaaatgttaaaaaaatgattcttgtacaaatataaagtgagcatatatcaaagatttatttaacttattcatgaggaaactagcagaatactacagctggtttaaaaaataaaagatatgagagaatatgatcaatgaatgaaagattgttgagataaggttacttcaattagatacaaaattggctaataatgtcctataggcaataaatctgtaactgagccatcatttctgttggctggaaccactaacatctctatcagaaaaaaaatcttttgtaatttattagtcttctgtaagctgacatttatctgcggagaacctcagttctattcaatgataaaagaaaaatatgcatttctctagaaaatcagtgttttgtaaacaagtttgttagataattcttcagtatgataaggcacttagtaatctttttaccataatttcagttttggataatttatcttactaaactctgtgtatattccacataaaatccaataaaagtaccaattatactggttaggtacagaatttttcagtctgatagagagctgcaagacaagcccaatttctttcttgaaaactgaaacatagtgaagaagaatatttacctaactccttgtcctataatacccactctatgactctgtcatggcatgtgccctaaataaacactgtccatgtctgttatttgatttgcgtgagagaaatgtatcagattttaacccatattgcataaattactagggtcttaactggatgactggtttggatggggaaagggataagagaggaagaaagaatgaataggtgaaaatcttctcactctaatgctttattcagataaagttatttagttttgatagacaaactgaaattgtattcacattttttaaaagagagttttattcaaaaactgtttttggaaacccttaaacttctaaattaaaagtcatatgcaattgcaacaatttgaaaaactggctgcatgagccagttaaacaaatagtaaagtatttggataaccaggcactaaggagattaaataaagagccgctatgttctaaatgttgataagccaaagacaggatagtgtgtatgaacctgctagttcccttgaccaacaggcatctccttctaaaaaggagtttgagaccttatcttgagaataacaattaagggcagaatcagaactaatacctcagtgacaatttgtacaattaccagtgaagattagctgcccaagatgatctagatctccatactacaaatctcttttcagtgagtaatatcaaaattatctctgtgtaagaatgcgtgataagaatcaggacccaaagagttaaaaaatatagtttatggaaatcattatttgttgttttagtaatccctacattttctaagtagtactgagagtttgttgtccaattggaaattcacatttaaaactcttaatctcaaaaaatatatcactaaggaagtaattatcttctctcaagtgcagccagtttagctgagtgtcaaacagcatttctacatattatttttctctggtgtggtgctgtctccttgggcttgtcttataagttgtttcacgctttaacactcaataaatgcatgatagttgaccgaatgttaacttatgatatacgacatttttctctagatgtctcccaagttgggagtactaccaaaataattccccaaaaaagcaaaaataaacaaacacaaagtaaattcaaacaaaaaaaggccctgcatcagtatccatataaccttcctagaagggcttcctttataggttaaattttaattgtgtttggtgttgtgggtagagctgtcagtattggaatattcatcaggatcttgatattaaggacttattatttattactttattttatgctcaatgacccttctgcctattgcatgtaaggcagaaatctaggtagaaggaatgcaggtgaataaagatggttagtccctagtcaacatggttcaaacataatatgagaataaaacaagtgtgtgaatctttacagtacaaagcagaaagtactttgtgtaataatgatgtttcagagcaggaagaactcacaactaattagttctaatcaaaattggggtataaaagagatagttgctgatagaggtcatcaatgatacatagaatttagctagaaaaaaaataagtggacagaaatgtcctggctatagcaggtagcgtgagaaaatgaagaatataaaacaggattaagacaatggagtagtatagatatagtatggtatggtatggtatggtatagtacagtacagaatagatatagtatagtatagtacagtatattagtatagtatagctatagtgtagtatagatgaaatacataatgtttgtaggtgattgtagttgattgggaaaaatagattttgcacatatcatagatgatcccaaatcctaggatgagctattacacttgatgcaatcatcaccaacataccagtgaaggcttctatttatataagctgtttaaaaatatttaatagaatctatttttgaatatctttctgttgttctatagactttattgaactagtgtggaactggattttgaatgcctaattaggatgaatttcataacacaatagaaaggctacagggttaaagggtctagtctggaatgatagatgcgcacaaattatgtcttgaccttgattgttagttgtcttattgaaacactgtacagctcacaaaaccactgggccccatatctccttgttatatggagttctcctttatttgagttgatccacttaatgctgtcatctggaggaaaataccagactgccacactgtgctgcattcttagtgcatttgttgttattcatatacactccgtaaggcccagtttgataggaaatttagaccaatgaaataacacagctcacctcctgactcctataatgacccaggaatattgtgtcatcaacaacaggttttctaaataatattgcctttaaaaatactttttaaaatatatcaggggcttggaagtttgaacatagtttcagaagtcaattgaatatttccttcatcccagcataaatccaggaaaacagagaaaggcatggagtgggatacacatagtcagagaacactaaggttgggcaacaaagaaagaatgtagtttcatgttcttagaaatattattattaagatgcatttcttgttaccatttttcagtattttgtgattaaaataaatgaggcaacccagtacccgaggttttggatgcatgcttttgataaaaatcctgaaacgagtacatgattacataaggaatcacgcaagttcaatgagcatccaaaagtcccagaacgagcttgtccagcccagggtacgcaggctgcatgcagcccaggatggtttagaatgtggcccaacaccaatttgtaaactttattaaaaccttatgattttttttggcaattcttttttagctcatcagctatcattagtgtgtgtattttatgtatggcccaagacaattcttctttcaatgggcccagggaagccaaaagattggatgcctctattctagaagctgattcactctcagcatcccacatactcccttgttttttattacatattctatagacatcattatttcataggtccaattaaaatgctcagggcttttgttttgttttttagccagttctttgtatgatatatttctcagactaccactatcctgatcagtgtaaaagataagactattattccccttagcatgaatattttgtttctaataatttgctctaaggtcaaaatagtgttgtcatgtgtctcacttcactcacttttctcacagttataaaacaacctcaaggtttctccaaatcaagctgttcttacaacaattttcttcctcctcctactggtttaattcactttggaacttcaagatatttacacaaatattcaacaaacttaatcttattatgttttacctccttgtggtttttgttatttccaaatgttgcctcagtcatgtaacaccttgtttttctcctaagcttttaaccccttgaacatttgataacaatttcttatttgcattcatcaaacataaatcaatttttgacccatagagggttaaagatagaacactccaatcatgaaggacactcatgtacttgacatttatgtatttataaatatattttaggtatggctatgcaaccctattttctcttattttttattttttgtcatgaaaatatttttcaagtttttcttatttttatatatatgaaatattctatactcttttggccactttagctgtcctgtagaccctatctagaccttccggagttttgctatttctttgttgcagattgttgaccagaattacaaacagtatctcatagaaacactgatttctacaaagtgagataaagcttcccattttatttctttggtctgatttcattgtaagagttcagtgagtcattgcctgccaggagtcatctacagtgagtcctagatcagtccacagctgtgacgagttcactattccagaaatacaagtttgaagaacttcctacccaaccctcccttagaaaattacccaaaattgatcatgtaaagcccactttctgcttctccatattcatttttatggcaaagtttccccactggcctggattttcactatgcagaagtgttcagggttatctacaaacataatacctaaattgtatatatttataacacatatatatgtactctatatacacatatattgtactatatatgtgtttatgtactatacatatacgcacacatgtatatgtactatatatacacatacacaaacacatggtttttttttttttattactaacctaaatataaaataagatctctggagaaaattttgttaatgtgtttccatcatgaaaacacacaataaacttgtttattgttctatctataacaaaatatttaaactacttttatcccaattcgaatatcattcttgtggaatttgccaaagtatttttttccttcaaattggaaaacaaacatgggactcttcttgggagatatttatattcttaatcaaagaacttcattatattcatcaaacaccacagcgctggtcacttacatctgtctaatgaattatatttggtgttcattgactctattctttttaatagaggtcatggtttgttatctatggaaccgagaatcattaatcatgacttggaattaatttgaagagatgatttttaaaaacttgtcataggcctgccttttgcagtacagggttcagggttccttgcttcatgataaacatttgcataaaagattgaagcttttagaaccttatcgtgttgttcaaatttagggatattaaaagaggaagaagcctgagatgaacacgggcacggcaactgatagcttcatccactgaagagggattttccagttgcatgcttgtttctctccctacatgtgctaacatttgtttagaaattttatattatgttgagactaaaaaaaatcaactctgaggtataaattttgatagtgcaaggacccatttatcatgcttgacatataatcttttaaattaaatttttattgtgcaatgattacagtttcacctttctttgtaagaagactttagagagatgccgtgtatcctttttatccagtctcctccaatggcatcttgtaacactagagtcaccaccagtatattcactttgatgctttaagaatacaaaatacttccatcaccacaaggacctctcctgttgtcattttgtagcctcacatacttccacttgtattcctcctcaacccctagcaaccactaatttcttggcatcatgaaccagagaatttattcatcactaaatctgttctgccaggatctgccactcttcagccaaaactcctagttactcctgatgacttctaggcatctgccctccttgggcatcaagtttactgccagttgccttctgagtcacctgcagtcaccactggagatgtaattgagtcctcatgtgccaaacttatttggttttcaccttaaaattattttttaaaagactattattcccacattttccctctacacttggtttactaatttgcatgtgtagtttatagggccaagctggcaataagttactgttatactcctctctttatttcccgaatctcctattcatgttccagtttaaactcagctgggaacaccttgtctcattcagaacttaatcacagtctttagatatagtcttttttgttttctttatatgcttattattaacatgtagtatccagtatctaatccagtaacagtcacaaattggcccatcagtggcaagaaatttaaaaaatggacactatagtgaggactaaattcaaaaatgacagccaaactggattttctcaagcacattctgctaatttgtattacgtttaaagagaaaaaattacttttgggtaattgaacatctatatcgcaattgcaatggtggttacacgaatctatgcaactggtaaaacctgtttataacaaaaaaaaagtacataaaaactagttaaatcagaataaaatctgtagtttagttaattttattgtgacaatgccaattttctggctttcatgattgtaccgtatcgtgtagaatgttattattggaggaaacgggggaaggttacataggaactcaactgtattagtccattcttacattgttgtaaagaaatattgagactgggtaaattataaagaaaagaggcttaattggctcatagttccacaggcaggtgaaactgtaatcattgcacaataaaaatttaatttaaaagattatatgtcaagcatgatgaatgggtccttgcactatcaaaatttatacctcagagttgatttttttggtctcaaaatgatataaaatttctaaactaatgttaacacatgtagggagagaaacaagcatgcaattggaaactccctcctcagtggatgaagaggaatcatggtgctagcatctgctcagtttctggagaggcttcgggaaactgtcaatcatggcggaaggtgaaggggaagcaggtgcttctgatgattggactaacaggaagagagtaagggggaggtgccccacactttaaacaatcacatcacgtgagaactcactatcgcgaccaaggaggatcttgctaaaccattagaaagcacccatatgtggctgggcgccgtggctcaagcctgtaattctagcactttgggaggctgaggcaagtggatcacttgaggtcaggagttcagggccagcctgacttacatggtgaaaccccatctctactaaaaataccaaaaaattagccgggtgtggtggcacgcccctgtaatctcagctactccagaggctgagacaagagaatcgcttgaacccgggaagcggatgtttcagtaagccggaatcatgccactgcactccagccctggaaacagagtcagactctgtaagaaaagaaaggaaaggataggagaggggaggggtggggggcagggagaagaaaggggggaggggaggggaggggaagggagggggataggagaggggaggggaggaaggggagggggaagaagggggaggggaagggggaggggagggggaggggaggggaggggaggagggggaggggaggagggggagggggaggggacgggaggggaggggagggggacggggagaagaaagtggggaggggagggcaagggcaaagaaacctcccatatcatccaatcacctcccactaggtcccacctccaacgctgggaattacaattccatatgagatttgggcagggatacatatccaaactgtatcatcaactatttttgcaactactatgtgagtctaaaattatttcaaattaaaaaataaaggcaaaacccatcaaacttacagattattatgtgatttaaagttcctatctctctcattctgtatgtgtgtgtatacattacacgtatatatctcagatagctaaatgcatgtgcttgtttgacatacaggtgtgttgctgttgttttttttttttttaaatttttatatattttttaatttgttgagatcacccaaggtgaaatgcagtgacacgatctggactcactgcaacctccgcctcctgggctcaagcaattctcatgcctcagcctcctgagtagctgggatcacaggtgtgtgctaccacgcctggctaatttttgcctttttagtagagacagggtttcaccatgttggccaggacggtctggaatgcctgacctcaagtgatccacctgcctcagcatcccaaagtgctgggtgccaccgtgcccagcctgacatcgtttttatggatttcaaaatataaatgtatttacattgtttgaaagttcatagtgtatataaaattgaagataggatcctgagatacgtatgaaagcattataatgcacaggtgtttgtgtgaaacatagattgtatctgaggagaaagaaatgacagtagaatactaatatcaaaaatatataaataagatgataggatcccaaagtataattttgtttgctttttagactaacaaaatattaccacatctaaataaatgaaaaacatgaatgacatatgctttttccatcgatttaatttttgttaacaaatataaaatgttttagaattttacttatagaattcaaaaatgtttccttcatatttataataatacttaaatatggaaatgaatacatcatctcaaataacactgagttcattcttggaatgtctttttttttttctgttagagattttctttcattttctttttatttttccccaggatgctatcatgcctacgtttctcctggttagtttcacaggatattttccaaagagaacttgaataaaacagacttgattaccactgttttattctcaaaataagctaatggctattaagacttgttccttgatttgagggggctttttggtatacttattcaaaaaggcagattcaaaataagctctctacttctttattcctcagaatctctgtttgtatgtaattggctaacaaaacccattgcttattagctttgtctcagtgctaaaaaaaaaaaaaaaagtccttaaaattattgcaaacctgcatctgtcacacctgattactccaggaggaaaaacaaaacaaaacagaacagaaaaaaaaaaaaacaaaaaaaagaaaaaaaaaaacttgctttggataacattttatgacaatagctttgcatcaggggacttacttatcttcaatgtgtgctctattcctcatgtcactctttcttccccttaattgaggaaaatgtgttcagaagttaaagttgtggccatctatttaaagttttatattattcagcttagaaaacaaataaaattttcatacgtacaagggaatatagcatcactcaagtaatgcccatcacattgcacaagaagtggataatctttcattacaaaagaaaagatggaaactgcatagatcttctgtaaatcagaagctgtataaccagctacttaactcaaattctaaaagccacctaatgtttgtatgtggatgacaccaatataacaaacatattgcttcaattaagtcaattatgttaatttgttgaaaagaatctgttaactgaatcattcagtatcccttaaacaaaacatagggtgataattttgcaaattattatttcaacttattgagttggcaacgtatgaacaaaaggcaacctgcatctatgttttaggataagtaattaggttctcacagactgagattttcatttaaaaagatttcccttttggacagtttataaagtgaattggaagagagactggaagcagggagagcattctaagagctctcaggggagaaggagggtttggccaaatacagtggccagactcgtgaaaagccgttactggagaggcaggacctccagcacctgggacattgtgaatgtgagtgaggaagaacaagagccatggacatgacagagattctggctggagaactaggaggatggcagcatcagcaaatggtgtgggtggaaaatagaaaataaacacagttttgatgataaaaaggcattttgttaacatcttgtagccattcaaataaagatgtttaatagaaagttggaaattcaggcctagatctcaaaatccaacttagggctggagatgtggatatgggaatcagtctccaatatttagatgggaatgagacctcgtagaaggaggttgagttgaaaaagtcagccgttcttgtccaagaatacaaatgggatcacagtctcatggagaagaaggcattacaagaataccaactgcaccaaaaaggttccttagggttaaaactaataaagaaggcttagatttcactttattagtgcagaagactaattgtagcacagtagaagagagatggaaatgagcttctatccttgaaagtttggatatgaaattgtctcttcaagaagtttgggaggtcaatacaaaataatgcaatattgtaactgaagaagtgagttggaaaggtgagttagttaaaagacatttggtggagtttgttttctttattttttctctgaaatcaagactttaggcttgtttcattaaaagagttgaggccgagagagatgttaaggaatacaggggcaccgtagaggtatagctaatggaacaagggagaatagagttagatgagaagatgggattaaacagcccgagtaggatttgtcccctgttagactgtagaagaaggccagttgggtagtagactgtggctagaccacactttattaatccgtttgtcagtaaatacacatttgagatatttctagattagactgattatgcataaagctaccaggctctcaggaggtcagaaaataaatctaggtagtgaaggaaacagataataacaaaataacaggaataagcaaaatattcctgttgaacttacatttgaagacaaaaaagcagatgatgtcacttgtgagaaagtagcgagaacagcatgacctttaataatccatagaagaagaagaaaaatccaatgaagataaaggagaagcaatcacagatcaaatagacatatgcaaaataagatatgttcttttttttttttttttttttttgagacggagtctcgctctgtcgcccaggctggagggcagtggtgcgatctcggctcactgcaagctccgcctctcgggttcacgccattctcccgtctcagcctcgcgagtagctgggaccacaggcacccgccaccacgcccagctaattttttgtatttttagtagagacgggatttcaccatgttagccaggatggtctccatctcctgacctcatgatccacccgcctcggcctcccaaagtgctggaattacaggcgtgagccactgcgccgggcctaagatacattcttgagtgagaaagattccaggagaagatgactaagggagatattcaagaagaattttaaaaaagattatttcattatcatcagttacctcattatcatcagtgatttttctgatttgatttgaaagaagaaacagcaacgaacaaattgctaaagtttaagagagcatggaagaggagggaaaaactgagcaaacaccatctattagagaagttttgcagtgaaagggaatagaaaaccagacagtacaaatggagaaacataatgtaaaaagggttttttttttttcttcccaggaaagatgaaatccaaatatattggaaaaaatggcttctgtagacccaagaattgtcacttattttagctcttctatattttgaagaaacattacctggtattaatcatccaatagataataaaaatggaagcatatgaaattgaggaagagtaaaattgttaatgctcaaatcagacattacatttagtattagaattattaatatttcatggcataaatttatccaactaaagaatttcacattttgaaaaagataaaattgaaagatggtaatttaccttgctatcacaaataattctcacattaactaaaacttgataattttgttgattgtatgcttataaaaagctcttggttccacattcagaaaaatattttatcccaagtactttccaaagagtatatcatcatatttgctgccattaatacttaacaaatacctgcgaaaagcaatggttttggagggtaacctgagggcagtataatctatctgttcttctagatactgtaaacaatttctagagtaagcttgtcagtagggagctgaatatctatctgcatcaaaagtgttggttactgctataaatttgtgtttactgagctgaggtttggcatttttccatggggctacattgaggaaaactgtaatgtatttcctatgaaatttgttgctgtttttatatggattttcttgaacacttcattctttatgtagcatagtttcttttatgtgaggatttgggaagtttctttctgggctcagtaccttgagtattatgcttctgcaagcaactggttagattttatttaagatgagccttgaaactaattctgtctgcatttatgtgatatgccagaaattttaaagccaaatttttagacaccctcctatgcaacaattgtttttggtttttcatatttttatcaagctagtacatagataagtatttttaatcaatttgtagagaaataagttcatttaacggtaaagttctttttccccaatatcttcttatttcctgttccactctccctttatacttttatatcaatttgttcgcttataaatgtagaatttgcctattggttaatgacttcttgggtcaattactagttagctgacttacttttccacacatctgactacttttagaagttatattaaggccaggcatgatgattcatgtctgtaatcctagcactttaagaggccaaggtgggaggattgcttgagcccaggggtttgaggctgcagtgagctgtgattacaccactgcacttcagcctgggctacagcgcaagaccctgcctcaaaaaatatatataatagatatttttaattctctattggttaattttattacatttaataatatacttacaaataggtctactcttctgtcaaattttggtaatataatttgactcttcacttggaagatgagtatattatttaccacattatttcttctacattttcgtatccatttctacctccaaacctctgcttcttaggttgtattttaacattgccaagattgataatgttagatttgtatttctgtttgtctaaatatttatttaacatatcacaaaatggatagcatttatctaattattttcatcctttcttatggcttgacatgaaggataaagaaaaaattataggaggtttggaaagaaaaataatatatttgagtaaaatttaaaatagatttctgatgctatattagattatcatctgaaaaaatttatttgtcaatatcttagaaattcaaatatgcatccattatataatccagaaattcttctcctaggcatttgtaacaaatgctcacagcaattttatttgtaatagtaaaaaaacctggaaacatcccagtatctatcaatacaaaaatgggtacaggttatagtaaacttagacaatgaaatagtacacagaaaaatagaaatgtgctactgataataacgatatgagggaatcttaacaaaattgttctgagtgaaagaagccagtgatgtttgattactttattatgaagttcaagaaaagtcacaattggctgggtgcagaggcccatgcctgtaatcccagcactttgggaggccaagctgggcagatcacttgaggtcaggagttccagaccagcctgggcaatgtggtgaaacctcatctctactaaaaatacaaaaattagccgggcgtggtggcctgtgcctgtagtcccagctactcaggaggctgaggtggaagaatcacttgaacctgggagatggaggtttctgtgagttgagaccatgccactgcattccagcccggacaacagaaaaagactctgtcaaaacaaaaggcaaaattaactatggttatagaaatcagaaaagtgtatacacacggtgaggagtggcattaattgaaaagaatattgactgaggggattgatgagactaatttctgggataataaaatgttctatatcttgatagggagtgagggtcacgtgagtgatcacatttctcaaaactaatcaaactattcactggttttcagtttactgtattaaaaattattatcattctttttaaaaaaatgacgtattgctccctgaacagtctgcagtttcactgagagatcaaatagtaaacattataattttactattcattataaaatgtattatgatataggtaagcacagaatttcagaatgagcatcaagtaaccccactatgcatttatcaaatctgtttcactttccttctgtggcacatattccagtctcttggacactaaggttaagatcaatatgatacatgaccaatggaatgtatgcagaagtgatattttcttcatcaaatctggccataaatcctaagttcattcctatatgtttgtcttctgtttctgtggtggacttgagaatcagatgttgatgacaaaaaccaaatgaagtgagcccggatccctgaatgactatgtggaacagtgctcctctgtccttttctttctatactgaaatgtgatgtgggcaaaaatcaatcatgtattatagtaaaacgctggaaagaaggaaacaagaaaggaggggaggaaggaaataaagaagaaaagaaagatggaaggaaggaaagaaagagagaaaaaaaggagagagaaaaaggaaggaagttggagagaaggaagaagagggagtcagagagtaagaaaagaattgatggttcttctgccagtgacttagactggagataaataaactatgggaggcaataaagccattaaaaagacagtccacttgttgagtaggctgagaacaaatgatcacaaagaaggaaacctattgaataccatcatcatgtgatgcccctaaagaataaagagaaggaatcaagaatcagatttttaagattttactttattaattttcaaagtcaaattattgcttgcaaaataatgctgttcttaatgcttctagtacgattattctaaaatgctttcacaacattgacaacattaagaagacaagatgtatttatttgggtaaagagcagtagggtctagagaggatattgctgcatatatatatatgtatatatatatatatatatatatatatatatatatatatatatggaatatgttggcatgtctcacaatgtttgacatgattttgcaataaaaaagagtgtatttttagcatagttcaagtgaattacccaagtgaacaagctaaatttgattggggtggggggttaatttttacatctctcctggcagttctctcaagatttttccatgattgttttctttttatcccatgatctctgacatctagccacattacataattataacgacatccccctacaactaggaaacccttacacattaccctggtgtctttttgagtcagtctagcatgctctattttttttcctgtaagatattatcaaatatatggtttttaactaccaatggtaatagaactggtttttgtacatccagaaataacaagacctatgaaatgtagatagatgggaatttggaaatgcacatttatattcatttacttaagcacatttattgaccactgaacactgtggtcatcagatacacagggaccaaagaggtatggtctgaaacctcacagctgacttacatacttctgaatcagttagggagttaatcaaaaacataatgaagtaatcacaattgagtgaagaggggaaaaaaaaaaaaaaaacacaggatgctcttgatacaggcaaactcccaaattggggcttagccaggagagttattggcttcatacaggaaagaactcaagagtacaccaacagaataaagtgcaagcaaagcaagtttattagagtaacagagtagggaaaaacggctgctccatagacagagcaggacatatgcagagtagcacttgtagattgctggctagctatatttatagctactccttaattatatgctaaataagggccaggtaattcatgaattttctagaaaaggagtggggacttcctggaaccaaggattcctctctttttataccatgtaaggtaatttccgggcattgccatgccatctgtaaactgtcttggtgctggcaggagtgccttttagcaagctaatgaaatataatttgtggataacaaacaatgaggacaactagaggttgctttctttgccgtcttcgttttagcttgtttattttctgcatttgaaacaggagttttcccttttcctcttcacagggcaagtgataggggtgtggctcacttcttcagtgctcccctgctcaaacccatagggagagcgtgcagatgggcatgtcatggagctcaaaccccatggcggtgtctagggtttagtgtttacagctcctgaagccctagtgggtgtgtgttaccttgtgctctcttagttttgccatctgcaggtggcttgtgttaatcggttcaattagaccccctgccttactgcaaggacagagagctttctgtaccctgggttcttgccttggtgtatcagaaaaatcggatcacatgtggtcttcaagaatgggtgtaaggttttactgaatggaggcgggtctcagcgaggtggatggggaggtcagaagggggatggagtgggaagctggtcctcccctggagctgggccacccagctgccagactctcctccagcgtcccttggctgaatccggtgtgcttttccactcctctgctcctctcgatgtccagacacttgtggctgtgtccactagggtctcagggtttttgtaggcacaggatgaagggtgtggagggccagagtggtcttagaaaatgcaacatttgagcgcaaaaacagaaatgcctgtctgcacttagttccgtgggcacaggccccagggtggagccccaccaggaccctgcccttctctatccagcacttctctgccctcctcccatatcgcattctgttttgaccagatcctgctttaatcagtagagtcctgactggtgctcagaaaaaaagtcctgctgatctcctactatgaggcaccctatggaacgaggggattgaggggtggcgaggcaaggtccctcctgtcaggaagtgctgtctgagctgagtcctacaagatgtggaaggccagccagatgaaactaatgagcagagactccaggggaagaggccagattggaagggtaacaggtgcagtattttatgaaggtccttcttatcttcctgcctcagcagggaatatagctagtcctggaaactcacatcaaggccgcaaaatggaaaatctatttctacattttgacataagttgttagcatggggaaaataaaatctaaaatctggcaagaaataaaatttcaattaaagggaagtgattgtaatgatcacaggtttagtatattaacataaagaatagtcaatatgtgtttcaatgccacagagtcattttatgttttaagcaagtaagatctctcactttagggaacattcacgtcattctcacataagttcccacctatgagacctgttgtcagtagcgaaaagctcttcctagatttagttacacaatagctaattgttttaggcacttttttttagtcttaagtaaaacctttacatgaagatacagagtctcattcattcgctataggagcttgtgatcttttatgttaggtctcctaaaaagtgaggatttagttaggaataaatatacttattctcatcataaaataatttgtgttacacttcaaaccccataatagtaaatttgagaaaaaaaaaatgttagttcatgcatcatacatagcatacttctagtactttatatagtctcctccagtttgataaattatattttccaagtgattacaaaatacttttccaaagtttactggttcttaactgtcaactggctggaaagtcttagacttgtgcatcctgtctaacttgcaagaaagatttaatttcaaagactcttagtccatgggctggcaaactgtagcccatgggacaaatcttgtccacgcctgttcttttaaagtttgtgagctatgaataatttttacatttcacaagtgtattttttaaaaaaaggaagaataataatatgggacagaggagcatgtgacctgcaaagcctaaaatatttactgtctggtactttgcagaaatgctttgcttcactacctcttagaccatctgaaatattgttttagctagaaaaaacagtgcacctagtggaaaattttcagttattaaaacttcagggatgtttattctaaaattaacattgtggatgacttacaatatgttaaaaaagttctaaattttggtatgtatttgtacaatttataagacaagaactctaaaagtagaaccataggtttaacattttattatattgattttaactttccttaacatcaagctttgtgagatacatatatgctatcttaattataataataaaccctattctaagcatatatacaaatcactgcctctaagagagatttaatagccagaacatgaaattcacaagttgttgtaaatggattttttattctttcaatgataaatttggctggcattttttatgtatctgcaaagcacttgtatactatttgtctaaatgaaggtttgattataaagagtattgttctatgcaagaaagattcaactttgctttaagtttttaatttttgatgcaggtttccaaatcttaaagattgtataaaaactcagctgtgtatctttttttccttttcacacctatatgaaaaactgtaaatgagtttttaaaagagccaagtgatatgaaaaaatgctccttttcaagacctatgatagtttattctttactttagtatttactaaataagatgccccctagctgacaaattcttctttccttttaggaaacagtgtcattcaaacttttaaattacttgtattaaaactgcagaggactttgggtgctgataatcacaaaagaagcttgatttaggtaaatgtgtgagaaaacataatattattgattttgtaaaaatttgtagaaataaaaaataaggagagaagtaaaatatgaacactatattagatgtactatctaataaatagaccagatatcaaatgtgtatctaaaaagtgatatgataaaaagcatccatcagactttaaatttgatattcaaatatataacattaaatatcaaaaataaaatatattgtatataaatgggaagatatttatttctagttgacaatttgattctcaaatgaagagagtggaagaacttgttactttgtcccaagtttgtctttactaggtattcgacatccagttttgttttttttttcccttttttttttttttttttttattgagatggagtttcgctcttgttgtccaggccagagtgcagtggtgcgatcttggctcactgcaacctccacctcccaggttcaagtgattctcctgcctcagcctcctgagtagctgggattacaggtgcatgccaccatgcctggctaattttttgtatttttggcagagacggggtttcaccatgttggccaacttctctgagtctgtttcctgatttgaaaaaatagcatccctgacaattttagagttttctttgaggcacaaacaatacagactatactagaaccgtttaaataatagatatatacatgttagacgttgtttttattaaatcaacggctacatctccttttatgtttcctaccttatcaaatactgatatttatggagacatttcacatatatttacagctttgtaatcaagacaatcaatggttcacgcctatggtattcttttgaaatatttaaagcttcagttaggaaaatgtcttaaatctcaatatgcttggatgaaagaagtggaaaaatcacaatctattggcacacacctatagtcctagctactcaggaggctaaggtgggaggatcgtttgatcacaggaattcaagggttacagttagctatgactgtgccactgtactctagcctgggtgatagagccagaccctgtctctaaaaataaaatataacaataaaaataacaacagaagcacaaactattgattttgagaatcctgaagaaaatatatagcatgcatttttccataagtaaagcaaaggcaaaccttaggtaaagcactattattctaaacctcaaatgtccaataacatcttttaattttgctggtgaaatctcaaatgcagtatatctaaatcttcactaattatctttcccttcaaatattgttgtattagtcaatgttatttcagttgctcagaaacaaacaaataaggaaacagatcaaataatccaaaacaccttagcaagctctggatttagatttctcaaatgatgtcatcgcagatgtgcttactttgtctttctctgacttccactcctttgtaatatcaaaatggccaacagaagctcagtgggaagagcacctccattcctgcagttttgtttgttttcttttcactcagcgtgcattggagatcccaaggtgtggtagctgtcctgctgttcttccacaccaatgttccaaacctctcctccctgaacaacctctgaagcacttgtggccatattatttcatctatcattttgtattttacattatgcaatggtcttctactatcttcttgggaatttctctttactcagagagggggattttagtgctttcattgttaaaaattataagatgtataactttcttgcttaaaactctctagtagatttcccttccagcacacataaatgaaatctagagcgtgatcataatgtacaggccctcctcattctgtccttgacctctccatcttctcccctgttcattccttcttcacactcttccaacaatactgacttccttgctacccccacaaacaggcacagtatgctcatgccatttgcctttctggcctttgcataaacgatatatgtaattgtataattataggatttacatataaaaacatatataacaatatgtacatattacatataacatagtgtcagtattgtatgtgtaggtatacatatatgtgtatgtgtgtatgtgtatatatatagacacatattcaggttcaggagtacatgtgaaggtttgttacacaggtaaacactcatgtgacaggggtttgttgtacagattatttcatcacccaggtattaagcccagtacccaatagttatcctttctgctcctctccctccttccaccctccactctccaggagaccccagtgtctgctgtttccttctttgtgtttattagttctcatcatttagctcccacttacaaatgagaacatgtggtatttggttttctgttcctgcatttgtttgctaagtataatagactccagctccatctcattcttttttattgctgcataattttccatggtgtatatgtagcacattttcttcatccaatctgggttgattctatgcctttgctattgtgaatagtgccagagtgaacatttgcatgcatgtgtctttgtggtagaatgatttatattcctctgagtatattccccataatgggattgctgggtcaaatggtagtttttcttttagctctttgaggaatcatcatactgctttccacaatggttaaactaatttccatgctcaccaacagtgtataagtatttccttttctccaaaacctaaatgtaaaacccaaaattataaaaactctggaagacaacctaggcaataccatcctggacataggaatgggcaaagatttcatgccaaagacatgaaaagcaatcataacaaagcaaatattgacaaatgggatctaattaaacctaagagcttctgcacagcaaaagaagctgtcaacagagtataacagacaatctatagaatgggaaaaatatttgcaaactttgcacctgacaaaggtctaatatccagcatcgataaggaacttaaacaaatttacaagagtaaaacaaccctgctaaaaagtgggaaaaggatatgaacagacacttttcaaaagtggccaacaagcctatgaaaaaaagctcactatgtagtttaataatataaatgccatgaaaactgcaactctgtctacattgttgatttgaacaatatctgctacatagaagactctcaaatatctcctgagtgaatgaaaggtgaatgaataaatacgtaagtaaatgtatgaatgaagcattttagcagaagggctaaaactgagtctcattgagttaggtgcccacccctggtggtagggagtagtgtctgcctctctagcatcatatggattaagagtgaatttttttttttttttttttttttttttgagacagagtctggctctgtcacccaggctggagtacagtggcgtgatttcaactccctgaaacccctgcctcctgggttcaagtgattctcctgcctcagccttccaagtagctgggattacaggcgtgcatgaccacacctggctgatttttgtatttttagtagagatagggtatcagcatgttggccagactggtcttgaactcctgacctcaagcgatcagcccaccttggtctcccaaagtgctgtgattacaggtgtgagccactgcgcctggggaagagtagaatattaagagtgaactttttaaagaaaagccagatgctattactcaaagggaagaggttgctgagcagtcgagcaataaatgttcatcatatctttccctctcttcccttttctgtcaccaatgcctgcacactaatatcttggaataggttgattatatcttctactcccttctttcaagatgttaataattcttcttttgaaatatcaaatctgtcttttatttatttattgcccctaccaccacattggtgttgaccttcaattacttgttgctaatcttcttgctcccagtatgatttcccattaccctggatctcattaatatggcttttattgttatttcttaacaacaagaacaacaacaacaatacatgctatattattttgtctctaatcagacagaacctgttaaaagatttatgatttttttcaacataactactttctgccagtcagacttgtgtctttattcctattccttgtgtattcctgaacacccttggttcatgtttcccgagaatctacaatcttagttcaaaaattcattttaccaataagcgcatcaaatctttttgtgagagacatacaggggaaaggaaaagtattttttttaagtcctagagaggctacccatacaaagcaaaatttcagcataactatccctggactctgggtcttataccctaggtctgaaatcctcctttatgccaacctattcttcaatatatcctagcccctttctctcttgtctttcaaacaccactctgtccttctatgcagctgagctctaactctgtagaatttgcctgattacatagccttcagggaactccaaatatcggtaaaattactagttacgtaatgcacttccatagttccttttaatgctgccttttgcaatatctttttagattttattttaggcctcataagactgcagatgtcttagagacagtgtttcaggagagatttttgttgtttttctaaatattgacataaaacctagcaacatgctaagcatatagttaattttcaagttgaaattgtttggtggcttttgttgagtattatttaagatcataaattttggattaacccatatccaattgtagatttaattcaagtgattttggtcaaggattctaattgttcttgcatttgaagccagagaacccaatagagatctgaaaatatagccatggtttaatggaatgcttgtttagatttttagattctttgtaaaactaacagctggctagaaaagtacctacaaagaaaatgtctttttagaaattgtttttctgatgaaattttgtcaacaagatgcaatgaggatgctctattaagtgttaaaattcaagacatactgctcaaatagttttgttttatggattacagaagtgtatggctatttttaaaaggcagtggtagtacgcagctcatttgagaaaaccaagaagagcacagcaggaatcgtcacagaagaacatcccaatttttaaaacatgtaattgtccatgttatagactaaatattatccattatgtggattgctggtaccatctaaaggttacataaaattgtttcaatgcggaggaaatctttcagtatacttctcataattactaggccttacattacacattttgtatttcggagcgcaggaatttgaccggggaatgcgggttggataacagatctactacaaacttgcatttgtgttgcttggatgaacttaagccagtgctttcaattccgaagctactctgtatttttttttaattaaaaacatctctcgctctttactttgtatgagtagtctaactttaaaacatcattattaaagataatttttttaaaagacaaaactcctggttttagatagaagcaaattcagtccttaggcaaagaagacaacatactaacaatgtaatataatgcctgtgttgcatcttttcatgatttaaaaaataatttttaaaatttctatttgtatgattttaagataatttaaatctgaaagttaatatcttctaaaagataaggctaaaacctcaagttatctattatagggacatttagaatgcatatttgtatgattttaagataatttaaataaatcgaaaagagaatatcttctaaaagataatgctaaagcctcaacttgtctattatagggacatttagaatgcatatatgaagctgaaactgctcatgtttaaaatagcacaagctttcatttatttgaattatatcttctaaaatataatagtttctttctttaaatcttccttgaattataactttatactgacattttctttttcattagatggtaattttttgagagtcgagtctatggtttcacacatccttgaatatcccatattatcttgctctaacttatgaaatagatagtttgtaaatccttgttgaatgatcgttatgtatgcctcccaaaaaatccatttgttctccgctgagaggaaaaaaataaaaaataaaattaaaaaaaaagacaatgtgaactttcagtatcagataaaaattcatggataattattcttttgacagaatcttctataatgaaaaaaactgaattaacatgtttctgatccattgaacaaattctctaaatgtgtctactccaataaaaggtagaaaaccctgacctcttcacaacgtgttcaattgttcttcttctctcactaatgttgaaatgttatctttaaatttctaatggttttatgggagaaaatgtggaggagaattttagagagcaagacatatggttagatgctataaaaatcatttattgtataaattaaatgcaaaatattagaactcatttcaatgtgtatggaacacaacagtggatgccatttagtctttcattcttttaacgtatgtttacatggatgaaaagacccacagaaaatctgacctgttttccacttaaaactggacctattttcacattaagagtaaggaagcagctttcttcaaattatttacggtgtaagaaatcacaagccctaccattggatgacatttgtgtttattctagtagacagaggacatgattgtttctaaagtatttttcccaatttttaaaatactatttccttttccaggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgtgagtatcgtattgtttaaatttgtggcaggttttatctttatttaaatagtaagctgttttattttaaattatttaacattacttgctttctctgacaataaactaccttctcatttacatatatatgtatctatgcatagatacatatatatataataaaaggttgtgtctctatttgcatgttataaatgtatattataaacacgtacagagactgacatgtcatatatcttaattatactttaggttgaagatttggaaaggttttttttgttcaatagactaaataataaagcttattaataaaattgccttgccttatgaaatatttaaaaaggggaaacctatattgttatctatgtatttgggtctttattatgggttttgaaaacatttcgaagaacttccttcgggttcactaagtatctctcttcagttatgcctattcctatactaaagccaatcactgggttttaaagtcaatgacgctttctctaccaaatttaatttattttttcaaattgatttggtcatctaaagaggttattttcccttaaatatattttaaagctcccttgttatttcttaaatacattatgcatatatctaaggattccaacatatgaatttgggggattataattcttctgtctattgttgctgctaatttttgcaaatggtacttgttttctcctactcctcttcctctctctttttcttcttatcttgtttgcctgtctgtcctttttatccttatccttatgcttatccatattctttactgtgacctcaatttctttaaaattttatctgtggaaatttgtttgggccaaggttgatggtgaattcttcttgagaggatatatctttgcttatttgcttctgtgaaggcgataccaacacagaactgctttcaagattatctccagttgtggttgttgtttctttatgagactgctagatagtataaatttaatctacgaacacgtgatttgcaaacattggcttcaaaatatgaattccctagtaaaatatactttcctcattcccggaaatttttcttccagctgttacaattccctgggggaacaaagatgctgggtatgaacaaggaggggatttggtttctctatgttatgcaaaaagtctcttattagcccgtttcctactcattcctataaacccacaaaaatgagttcacactaagcagaaaatttcaaatgcccccgttggacaagctttctaaaatgccctagacacttagtattttatataaaagaatatatgaagctttcacctctgtacacatttagtaacagaaattggtcaaaatattagctataatagtgcccgaatactgtcttattaattcataggcaatagtgttatgtgcaaactacaataaaggggtcatggaggtcatttaaaaattctcaaaaactgtttatttggttaccattttattgtagcagataaaattagtagagagacaaaagatttagctcttcaggagaatgtagctctttaaaaggaaaatttagcatttctggtaaggcccaaaaagaggtctaacataaattagaatctttggtcctatgtggtctagacattcatgaacagagtgtcatgttcacacatagtcttgctctcagcatagcatcatgacgggaaggccagaagaaaatgtgatatttttgtgaccatcacaaattttgttaagagccatgtttaacttttagtaaataaatacagacacacacacacatatatataggtatatatacacacacatatacatacacacacacacatatacgtgcatatatatatatataatccttcatggagactacgtgtatgtgcaatttattttattagcaattatttaatgagcacttttcatgtgtgataaatatattaaatggtagcattaccacagtagatgagaaagacatggtctttgtgagatgaagtgggacaaataatttaatagagttaataataataaaaatagtaaaagttaaaatttacccaaaagcacatagcctgagtgataggtctgaaagggaacccaggtagtctggtacagtgccaaagctcactatcaccgttctgtttttaatcccagcaaaataagcacccacctgaccgtccacagtttaatcaaaacatcatgtcaacaccccgcaaccactgagtaggccttctcccagttactgcaactccttaaacataaaaattcacctgatttgtatcaccaaagattagttcttgtttttcaaaaaaatttcacacagatggagtcataaaagatgcattattttacacttgacttctttagttacaaatcatatttctgagaattatctgtgctgatattagagatattagtttcttttcctcagtattattctatcttgtgaatattctacaatcatttgtttatttcatgctgatgaacgtttgagttgtttctagatgttggctatttatacagaattactaaaaatgtttccaatgggtatagacttgggggggtaataacaaactagcatatatgtgtgttcacctttggccaataacaacacaaatttttctaatttggttatatcaatttaaagtctccaatgcaattaactggagttcctgatgcttacaaattaagatatttagtattgtttaaaagtttaggccgggcgcggtggctcacacctgtaatcccagcactttgggaggccaaggagggcggatcacgaggtcaggagatcgagaccatcctggataacacggtgaaaccccgtctctactaaaaatacaaaacaaaattaactgggcattgtggcgggcgcctgtagtcccagctactcaggaggctgaagcaggagaatggcgtgaacccgggaggtggagcttgcagtgagccaagattgcaccactgtactccaacctgggcgacagagccagactccgtgtcaaaaaaaaaaaaaaaaaaagtgtagccattctggtgagtgtttgtcatgtctcattttagttaagttatgtttctttttttttttttttttttttgagacgtagtctcgatttgccacccaggctggagtgcagttgtgcaatcttggctcactgcatgctctgcctcccgggttcatgccattgtcctgcctcagcctcccgagtagctgggactacaggtgaccaccaccacgcccggctaatttttttttttttttttttgtatttttactagagatggggtttcaccatattagccaggatggtcttgatttgctgacctcatgatccgcccacctgggcttgtttctgatttttgaaagaggttatgcttattggtcatacgtataccttttttttaagtgttcaagaatcttgctcatatttctatggattcccatttatctatctatttatatatctatcatctatatagcaatcatctgtttgattgttttaagtagtttttgcaggcaactcttcttcattctcattacaattgctagacacgtatttatttttgaggtgacatttttttaacaataataattttaaagcaaacattgtcaatgaagttacttaagatccacaggtgtagacttaaactgtgaccacatgttctgtaattgttacaagtagatttataaagttgtgagtttgtgctgtcatgggcttttccatcaagcctgggctttgacaattacaagacaagaaggaaaaataactgaagcaaatcaggaagcgagacttttccactgtataagtccctttgggggaaaatcatatagctttgggaaactgtattaacatttatatcaatagatgccagtggagtaagtaacttagcaacacaaaatttaaaaagtagcatttcagttggatgtagtaggttgggtaatggcctatcataacataaagcctttattcttggaagttgtaagcatataagtatttgcagatgtgactaagttaacaatcatgacacggagagacaatttttttttttttttttttttttttgagatggagtctcgctctgttgctcaggctggagtgcagtggcgtgatctcggctcactgcaagctctgcctcccgggttcacgccattctcctggggagaggcaattttacattagccaggtgggccctaagtgcaatcacatgtgtcattgtaaaaggtagacagggagagatttcacagatgggaaagaaggagagaatgtgaacaccttggaaccagaggctgtagtgatatggcgataagccaaggaaggccagcagctcaaaaggcagatttttctctggagggaatgtgatcttgccaacacatcgatttcactcagtgatgctgctttggaacttctgacctccgaagttgtgaaagaacaaatttctgttattttaagccactaagtttgggataatctgttatagcaacaacatgaaactaatacaagagtcaatatattttagaaaagaaaagacaaaaatcggcctgagcaatgttctctgatagaactttctacaaagatgtagatgttgtcaatatgctctagccactaaccatatgtggctactagcatgtgaaatatagctaagacaactgtggaaccaaatttttaatttaatttaatttttaattcatttaaattcaaatttaaataatgtgactactggctaccatattagacagtgcagcttagaggaaccaaaacatcatgtatgtttttcatgtctttttataacataaaggacctataaaagttatgttttaagtgtcagtctctattgttttttcttagtttggaaaacaaaaatttaatcatcctgaaaactgtctttactgtcaataatgtaataaccagtcatcttactaaccacacagtcttagtctgttttgtgttactataacagaatatctgagactgggtaatctagaaagaacacaggtgtatttcttaccgttctggaggctggggagctcaaggtcaagggacctgcatctggcgaaggccttcttttcccattgtctcataacaggaaacagagccctcgtgacctactcatgtcttaaaagtcccacctctcaacactgttgcattggggattaagtttccaaaacatgaactttgaaggacgcattcataccacagcgtacaccaaatgtccagataagattctttttcatttattatttttgaagaatgaaaattacacttatctcttttccaagaaaaatatacatgtttacattttaaaatatatatatgttaaacatatttgttacgaaacactttccaaaagttacttccaaaaatttactggctaatgtaaattttctatactagagttcaaactagaatgagtccttagaagatgatactctgttcttgagcttagtgaactgttgtctcaagagctttctttggatttttcaatgagaaaaggaatcatataactttgagtggggaatgtagattagacacagccccccattttggcttcctagagaatagcagtgctgtgtactctagggtctcagcaaggagaaacatagttttgatcctgcccgtggaagagagatgaattctctaatctgtctggaaactcctgaaagggtgtacctgggatctatcttaaacctgcaagagagggaatggggcttctttcactgcaaagtttgccagaaaactagagagagagagagaaatcacaatgtgagcactgtttctgtttgactgtgtgtctggtgcaactccccttgtgtttgtcatctttcctttgtgcagttcctccatgatcactttgtcatctgagaaatgaggtacttctcaaggctgaaataagacgctgactctattccaggtggagaatttcgttccaggccactgctctgaagcctttagggcttctattgttcctacttcctgacttgtcttgaatataatatgaattccaatttcaataaatctaaactcatttgaaatcattctgcttcctctacgtttggttttccctcaagtttagttgaaacaagtgcatgcagttatttttaaaacttagcaatatgtcccatgccttttgattcagtgagctttctcccacagcgcagacactaatcttcttacgcgataccagtgggacttcataaagcaaaaggaagaggtctcagattaataatttcaaaaaatcatttatggctgcattactcaaacattcattttaaaaagccaaacacagtgcactgattaaagtactgagcgtttttgatggcaaatacttaattagtttttagtcagagtcctcttaaaagtaaggacggcaccttgggaaaccaaggtacacacatcgaaactaatttttatataggcttttaatttggatgaataaataataaaacctgtatgtcattcaatgcaaatcgtgatggaaaactgtcttgctgcctgagaaaaaaagaaaacatatcaggagaagttaaatacaaataagtaaaagacagtgtttggtcattttcatgctgtgttgatggcacgtctgcatctctagtgagaataccctcttctagggtcacacactaactcccctcactctcattcttcccaggcaagagatgctgccatgtacagatgtgttagtttcctggggtctctgtaaaacagttctgcaatcttaagatgaaatttaagacgatggaaaggtattctatcatggatctagagggcacagtctgaagtcaaggtgttagcaagggtagttccttctggaagcttggagagagaaacagttccatgtccctcgcccatctcctggtggtggccagaagtccttgatgttctttggctcattgctgcctcatttcaatctctcctttgggttcacattcacatgaacttcttcgcttttgtctgtgtctctgtgtcttcaaatagtcttcttctaaggacatcggttattggaattaggatctaccctaaaccaggatgaccttatcttaacaagctatatccacaaagacccacttttgaaataaggccacgctttgaggttttggctggacatggacttttggaaacactattaaacacaatattatatatacatatatatgtatatatatatatatatataaatcattaagaatttatgtttacatcagtttaagtgagcaaaaaataaaaaatcagttctggaagtcaacctgtgtgttcctacttaaattagatgtttaattttgtatcatacagaagcatcccagatacttatattttgtgtttataatttcttcaatttattcagtgaacctgtatcgcattcaggcatttagaaacaacctaaagcatgaactctgccctcaaggagatgaatttttggcagaataaatgaataagttaatagtttaaatactctatgataaatgctatgacagagaagcaagcctcgcctatgttgattaatgaaataaggtttcactaagaagcaacagaaattaggggtaaaggagcattcaagacaagaactaacattttcaaagactaagagacacagaggtaagaacataatttatttcatatttggagtttttagttagcaacataagtctcatttcagtgtacaaaaatatacaaattattatgttgcttagaggatcaatatatttgtgacagatttgttaatcttattaatattaataagaataaaaacattgaattatactattttaaaggcattttgctaattttaaatcttaagtgcaaatctgaccatattacatctgggctgactacacgttaatgatgctacattgcctataaagtccaagctgtttgtttgaaatttaatttctgcccacccactgactacctctgtagtcttaaatccagtcatattgtgttttatgctccaaatatgaatacaagctatatttcctaatacatgagtgacctgcttgtttaacaggcagtcattggagatactttctctaaccaaaatagcctctccatcatcctttacctgaccaatcttttttatctttcaagattcagttgaaatgcagtctttaatgagaatcatctgaatttccacaatgagtcatgtgtttattttcatatgaatatttatcagatatcatataccattatattacataaatatttccaatggaatatttaacaaaataattcaaaataaagtcaactgcaagatactgggaggaggagacagcaagtgtcaccttattcatcactagcatccccttaaatggcaggctccctgtacacaataaatgtttgctgaaatgaactgacatcaaatgtaaatgatacaggcgtaatttattccctcagtgaaaactgattactatttgaggatgcatagattcttttattggtggaacagggcatgattatattgtatcatattgaacagtgctctaaggggcctacaaaatattgaaataattaccaaactaaatataataatagatgttcaaacagagctatagacagcaaataactcagtgtttttttctaatttaaatatttgtataacttgtattattatttctggttattattttaaatcacacttttttgaggctgcttcatgggttatgtatatggattgcttatcagaggaaaaaaaaccacccaagatccagagtaatgtgaaaataaaagtaacttaacataaaaatagatttaataaatatcactgccaagttatacaagataaactgataattaatgaggtaattaaaattgtcatgtgctgtatgacatatttgggatatgctatgtttctaagttttcatgttattagatttaaaaaaaatactgtaagttgtaaccagagatgttcttgccattaagagatctggaacttagatttgagcacatgtagtattctttagtgcttttaagtatagtttgggtttcaaactagaattggagtgctttgtaatagacagctgtggattgtcattcagtgtcagtttgagataatgacttcctggtctgtacatataaatattattgtagggataaggctaatgatgaaagtgcacatgatagatactttcacataatttgggtataagccttttttgcaggggttggctaaggtagatagctagtggatcagatactcagtggatctcattcctgggttaccatttgagggtgacatttgaaatgaacaaatttaaagcatggaaatatatgttctaattttttattctatggggaaacagctatcagtatttaattgttttttttctagtgtaatttgtttacttggaagaaacttacaattgactttgttcagtgagagaacatggtgagcctacctttatatttaggaacaagacagttacaattggcagctagcttatattttggagaactatttaatatgtcactgatatagagctagagtcacatcatattactgtaaaatctaaatttaaatttactctcaagaactttcaaagttaaactgacatataaaatcaagagtgtcgatttaaaagcaaattaaaatttctggcagagagtaatatgcaattagacctatgtctgtcactctgaaatatgaataacagtatactttctagaataagggagggtataacttttattatacatattagtccaaaatttttcataaaataatttcccaagaaatgtaaacatattaaaacaaaagtatatatacacattttggtgcctggttaaagagaagaataaagtaatgaaaaagaactatgtttcactgtggtttataaataagatattttgattactacaaagaggagccatatgtgtactctataagaacttcaaagctgaaaagttcccaagagaccatccagcccaatcctctattttactaacgaggaaaccaaaacccacagagttatgcgacttgcataagcgaattaatcgcagacctagaaatcctgcataacaatctagagcatagcttcctctctgacatttaatacctctctcctctggttcattcttctttgtttcttcttcacccgtaagggctttttataatcttagtgatggcctacagaaaatacaattttgtgaattctaatgaccatagaaatgctttggcctatcaattatcaccgtaagaatatataggagatatccagtaagaaaagtatctcactagtactgtgcattctacatgtccagcagaaaaatttaaatgactaatcttcataatgtactcattggagaacagcttgcaaataaacataactcaagctttaattgcattttggtgcagaaagtttatcaatatcagttagtgtattttctcaggtaatcttacctcctgagatacgttaactactttttatatatatgttaatttttatttatgatagatgattgcagagagtactagagcctaaattacagttatacagtccatcaacatttcacttataatccgtttaatgtaaggaaagcaataaaatttaaaatgctgcaaatatatataagtgattcctttattagcttttattcttatgttgttagttttcattatcacctatttaaattagctagggagagaagagcaaatatttaagatggcagtaattgtcctcatgaattaaaagtaacaacataataaaataattatttagtatgcacactttaaaaatttcaagcaatttaaattacttgaattagaaatcagtgattttcagagattaaatattcttactcctatcagaatagtatcagatcttttatagttagacttgaaaagaagtaatccagattttcaatttgagatttttatattttctatgcttctaaatgaagcatgtatatttttctcacatgctcaaaatactgtcatattaggtttttcacctttcatgctcgtttggctggacaggaggagttaaagaaactgtcagtgttctcttttattaccaattaatgggggaataatctcaagaattaaagaaagcattcaacccgtaccaatcattttgtaaacatctgaatactctaccctcaggcacccccaaataataatatttgctaggaaaaaagtccttatttatggaatgtttttagcaagatatccctgtgttaggttgcttatggtaaacacttagcaactttagatttatgatcacggctctatggaaaatcacttatcagctagatgaccatggaggaatgaaatggagatgcttcataaccgaaatgcttctgcgtgaggcaataaactgcatagcttattaaggactgtccctattactctaggccagagagcacatgtctgatgaaagaagaaaaagcctgaggaactatgcagtgtgtatcagatcccaccttgctttgcttgtccctctgttttaattacctcctctttatcccatgggtaagggaggattcctgtcctggggttatgggtatgacggaacacctgacacctgacgtaaagcaactgagaccaacagcagtttattagtggcatttccacacaggctttgagagaaaggcatctcaagtctcgcaggggacatgggggttgtccttgggaacagagtgagcaatcagacactgcgggaggcaggatttgttgtatcaagagagtggtcttccccctggttcccaccggaggatgtgattggcttgttcgaataattctgtgggtgtagggtaggagggaacggaagcccaatactcaaggagaagtggaatatgcctgatccccgagggaagcagcgtctttttattggaggacatatccgcaggaacaaagttgggaggggagcttgcagtgaggtcactggagaccctccaggcttttcccagatgtcaaagcacacataaactgggccttacttttcggccttataccacaagctcttaatgttttgttttctacaattattaataatctttggctctacataagatgtttgctttgtgtaaatttgatttaacaatccgaatttaatatcaccgtataggttgcattaattactaactttagccaaatcaacaacatgaacaacatgtaaaatcccatataaaattttttcttccctgttatcagaacagaaaagaaaaacttccctgtttttcttccctgttataaaaattatttcttccttcttaaccaaccatttatcatgtctatttagctgtatgtgctcttttaaacttgctgtgttggctgtatttgtgtatcataaatataaactagaaaatggacaagtagcttcctaaactttgaagtgcaaatgttttattaagggaaaaaaaaaccctctttcccatggcattgcacttccatagaaaatataattatttcccccaaatccttttacagggttttgctatgttccaaaggacagggactgagctcactttgatttgagttggactctgaacatggttggattaacagcctcggtcattaatctctactccaaatttcagcatgctgtgtccatctattacaggtgtgggtgtgttttttgttgaaacaaaataatgtatacttactaatgctaaagttaacgaacaaaagcaaggttagtaatttttgcaacaaaacctacccagtgagggtcccagaaggctatctgagtaatacagtggggcaaatggtttcaattcaatctctggatgagctttgtttgtttgtttgttcatttgtttgtttgttttggagacattctcactctgtcaccgagtctgcagtgcagtggtatgatcatgactcactgtagcctcgacctcctgggcttaagcaatcctcctgccccagcctctgaagcaactgggactacaggtgcacaccaccatccctagcttattttttttatttatatttttgtagagatggggttattttttttttggtttgtttgtttgtttgttttccccacgttggttttagactcctgggcttaagcaatccttctaccttggcctcccaaagtgttgggattacaggtgtgagccactgcaccaggccaagatgatccttttcaacagcgtctaagttaaaatatgctacaaatttatttaagatcttgctgtaaaataaatcatttgaagtcgatatcatgaaacaacaggagaatgcaatgtgtttcctcctttgtcaaccaacagtgtggacccagcctggacttgcccacaaacagctgagcctaaagcctgcttcatccatcacctgaccttccataatgactctatatcacctcatttcttctattttttttaaaaattatgctgctctttctctttaatctagtttttcttcttcttatatcttctttctaaaataaaagagcacataaatgttttaaaacaaattagattttcaactttcagtaaagataaagttttgtcagtagggattaaagtttgccatcctcgacattgttgatatttctggctctataattcttggctttggaggaaagggctgtctcgtacactggaatcttttgcaacatccctggcttctacccattcaatactagaagtgcatcatatttccctcagttgtgacaaccaaaattaacccaaaagtctcctagtggcaaaactgcccctgggtaagaactgctgatatagatggtgctaaagtgtcacctagaaatcagttcattgtgttcctaggaactacgaaaggaaaattgacacattgtaagaattgactcaacattcatttgatttatatagcagtgtctgttatttgcagaaagcacgtactgcatgctgagatttccatagacttcatattgataaggacaatatttatggtgttaaagtatgcctacatatatagatctcctatatatgtactgcagataaaaatactattatgtcacctcatcagcataaatattgcaaaagaaaatgacctcttgaattctcatatcgtttgtctgtgatttgtggagaattacacaacattacttctaaacattttcaatctaagtggttttatttttattaattaggcattactttttattttgccattaaggatatcatcttttcaaccaggatcaatttgaatctgtaatctcctttggttaattggacattttccttattgtgaatttaagtttgggatcaagaggagattgattagatctgccacatagtttggccggggattatttatatagctgtttctttgcatttcacttttgctaaaaaagtagacattcaaaacaatataaatttgtagtctgttagcaaagtgtattctctaatattctattatagatatagtatgttctatagagtatattacactatattctattctattatagaatacactttgctaacagaataaaatttatattgttttcacgcactctattcacatttaagaaacattaaccttcataaatagcataaaggctgattttctctaaaacagagcaaacaaatcaataaaataactttgccccacttcttagcttccacctcaaagggttcttttttgttcgtttgttttgtttttgtttttgctttttgagatggagtctcgctctgtcatccaggctggagtgcagtggcgtgatctcggctcactgcaacctctgcctcccgggttcaagtgattctcttgcctcagcctcccaagtagctgggactacagatgtgtgccaccacgcccagctaatttttgtatttttagtagagacggggtttcaccatgttggacaggctggttttgagctcctgacctcgtgatccacctgccttggcctcccaaagtgctgggattacaggcatgagccaccattcccgtccctcaaagggctcttttcctactaaggaagtaaacgatgcaggcctgattgtgtgtttttttgcacttttaataacaccttcattgaccatgtgacaccacacaataccactccttggtgatgtgcttagcaatcccaaacaaacctttccaattcacataaaatgccacacaccctattcctccctacctcttagggttgtcataagaatttgaatgatacatgtgaatgctcttctgattttgaggatgaagtcactgtgtcatcttaatcatgcttatttggagttgtgcctagaggggcataatacacagtgtgaaaatatgttctattgaaagttcaaacgattgctttagtggttgatgccattaaattggtttggaggatgttttattgcatttaaattggactgaccacctcaaagagctatttggataactctaggcaacctcagtctggcacagataatccagttacttagtaagagtcttgagcacaaaactggggagggggttatatgataattctgattttttttttttttttttgcaaataaaaagatactcttgactgtgatcttatttccaattgtacaatgggttcaccttacaaaattaagtatagtactatccccatgcttgctttttaattgaggaaatagtgggtggtttggttaactaaacaaccatttgttagattaattctcactagcttgattcagaactatacctagtaggaaatattggagctaggaactgagcaataagcagcatttatttagggtgtctggctcatatatattgtgtccttacaacaaagatgcaaaacaggtaattattcccccattttgcaaatgacaaaaccgaagttgaagaagtgaattaacttactctcataacaagcaatgtcactttaatttttggcctttctaccaaagcatgttacctcttaaagacagcataaaatcagagcataacagattcatagaaagaatggttataataataattactatcattactactataattatagtttgtatccagaattgattaatcattgattataggtcagatattgtgctaagttccttatttaaaacctcacgatactgctacaactatcttcattaggaactatcttcattttaacaatatgaaaatgaaggacaaaataattttttgtttattcattcaatcactaagtgtaaaaataagagcgattatgtatttgcttgtttagtggtgccatattctcaaaggtcccaaagtaacaatttaaaaaaaaaaatgtatctgtccttgaggggaacacagtacatctatagtacaatttttcctaagagtagttatttgaaagtcatgacaaaaagggaagtggtcaaataaactgtgttgaacagccattgcaaattatttaaagcaattttaatggcaacaacaacaaaaatatgtattaggtgaagaaaagcagaatataaaattgttaatacagatcaatatctctttcacttagcagtttgatttcaaaatgtgcaggctgggcacgatggctcacgcatgtaatcccaacactttgggaggcaaacacaggtggagcacaaggtcaggagatcgagaccatcctggcaaacacggtgaaaccctgtctctactaaaagtacaaaaaaaatatctggggccgggcgcggtggctcacgcctgtaatctcagcactctgggaggccgaggcgggcggatcacgaggtcaggagatagagaccatctggctaacacggtgaaaccccgtctctactaaaaaatacaaaaaaattagccaggcgtggtggcgggcgcctgtagtcccagctactctggaggctgaggcaggagaatggcgtgaacctgggaggcggagcttgcagtgagccgagaccgcgccactgcactccagcctgggggacagagcgagactctgtctcaaaaaaaaaatagaaaaagaaaaagaaaaaaactgcgcaaaaattacatcaaaatactaatcatatttctgagatgtagtattatggataaccttttttatgtttttctgcattaatattcaataactttattactaatattcaaatattactataatcgctgaaagacaaatgctgtatgattcaacttatataaggcatctaaaatagtcacattgatagaatcaaagagttgagcggtgggtgccaggggccggggaggaagaggaaatgtagaattactattaatgggcatgaagttgagcaagatgaataaattctaggaatgtgctacacaccattgtacttacagtcagaaataatgcattgaacacttacaaatttgttaagagagtagatctcatgtgtttttaccattgtaaaataaaattaaaaaaatgattagtcaaaattgtgaaaaatacaaaacatatataatttgctttaaatatcattttaaaatatgtacaagatttgtatctcaatgtataaattcagatgcacataaaagttctcatccctttatttatcagttttaattttaagcttccatcttgctgttctttcgaaaggcttactctaagtcaatcctggtttcattttatttcagggtcttatcgtgtcattgtgtgcacacacttgtatgtacatacagtgatgcatgtgtgtatacactcatgtgttcccagagactagttgtgatacttacagtggcccctgtttgtatttcctcctccacgattcagtgattctctgctgcttttcctgcagtcttgggaacttgaatcaattgggaatgtgttgatggtccacctataaataattatcccaaaatagcaaccaattactttatttgaaaacaaaacaaaacaaaacaaaaaaacactagctgaataaactagtatacttagtattcggatactaataacataattcaaaaacagttctttggccgggcacggtggctcacgcctgtaatcccagcactttgggaggtgggcggatcacgaggtcaggagattgagaccatcctggctcacacggtgaaaccccatctctactaaaaatacaaaaatttagccaggcgtggtggcgggcgcctgtagtcccagctactcaggaggctgaggcaggagaatggagtgaacccgggaggcagagcttgcagtgagccgagatcgcaccactgcactccagcctgggcgacagagcgagactccgtctcaaaaaaaaaaaaaaaaaaaaaaaaaaaaaaaaaaaaaaaaaaaccagttctttatgatatatataaaattaaaaccatagacagtacctacaatctatattttcaatatcacattaaaaaagcagtgtaatatcagtatattattgtgatttatatgtcacaatttatccctgcttaaatatcatatagaatgcttaaaattgtattaattcaaagaattattcacaatgtcattcccaatgtcactttttagtttagagcagagtatgcatgcacagggattatttgtggtaaccatattatgaagtgtagcattatcttttattataaatgatatgatataatcaaaagagatggccttttgggtttaaagacaaaataaatgccacgtttactaaatgggtatatttgagatgattgcttaagctttccaaatcccatttttgccactcataataggaataagaatgcttacttcatagatttgtcatgaagattaaattagataataaatgccaagtgcttagcaccatggctggctgaaggtaaggatttatacatattagcccttattattattgctgctgttgttcttagttcttccctttggtagtgcatagagtcatgtagtaactgtttgtacttcctatattctcaactctgaaatgaattttattatctagcgtctgttcttaacctcacaagaaaacatgccttaaacattaaataagcataaaaatgaggtcttgatgctcacacagagaaataagcattttccagaaggagttgccttcaaatcaaaatataattgatactactcagaaaagagattttctctctgcactgattgacttgaaagcagaatagaagactggagtcacggagccagaaaatgtttagaggtggctggcttcacatgtattttctagtccaactattaagtttgcagatgaagaactgagaactccctgaaagaggaaacggctcctcctgagacttccccataaggaactagtagcagaaccgtattggatttggttttagtgcttagccccatgctcttccactatattacatttaaggtaacatgtacgttttcatttctattagaagtcatcaatgggtggactttgagtgtgagcattttgccttgcatgtaatagatattcttaaaatagttgtgaaagaatgaatccctcttttatctatcctatatatgaaatgactttgttggtaaaaaaaaatggccaattgctcagcaatttacactagaggataattttacaaccgcaggtatgggacacacttgggttcctttccacacttggacattttatagatgcatttttaagggaggaggagataacagcaatctcagtttttttctggaaaataaaaataattgttgtatgcccagtggaactatgaaggagcatattgggcccaagaaagtaaagaatgtctacacttaagctatttttaaataataaattaattcataggagaaacaggaatgagaggcaaaaatgtctagtaattaatataaagtccagcaaaatgacttaaaaacagttatatttgcaaagaagactcagcacacttatgtcataaaaatccttgtctagtcacagttttaatttatatataaaattaaaaccatagacagtacctaaaatctatattttcaatatcacattaaaaaagcagtgtaatataaaaaatataaaagcagtataaaaaatcttatctagtcacagtttcaatttctcacaattgtatgatcattttgacattataggagagtaaggatatgtaagttagctaagaattacagcagctttcgagaaagataagacagagaagtgagagatggaaagaaatagggacaactcatcgaaatcaatataaaatatgttagttaatagcactgtttgcaatctttaacaaatgtcctctagtggtttttaagtatagcacttcataagccttttgaaatggcatgttaaagtagtattaaaaggctgacttaccattagcatgctatttaatgtgtcattttaatttttaattttggagagttcctagaaatagtgtattgagtgagcattaacaaaagattattaaaactccaatgtcaacttaattgatatatcagaattcttatgacaaatagttcataaatttgtttcacacattatgaaatggaaaaaagtaacaggcacatgctctgtatattgctgttaagtgcatatcctaccataaaaacctctccattgtataacaagaggcttgtgagatacttgatgaaagggtagcatctcacctgctaaatgatgtggaagaattctttgactgaccacaccatctatagagatttgacattttccctgtgcctcacatagcattcttcacaaaaggtgagtgttgtttgtattaccttgaatgcacacacaccgcctttctttcctcccatttctttcccatctccagtcacagttcttatagtgtatttttctgtaagtagttgcaaaatattcaattaatagcagaggggacttattcaatgtcaatatatccttaaataaagaataataaagaagaaattactgtagggaatggaaaatcattctctccatctccaacaaaactatataaaacaaatccattttctaaaaatgttaaaatcttcccagttggctgaccttgtttcagtccagaaagacacagatttttagaactaagactgtgaagcccacatcaattttgcagtttcaagagctcaaattccttatgaaataagctgatgaaagtgtttaacctgtccaaatgaaaaataaaatgctgagtatttaaatgcctctgaaattaagtaaatctgttctatacatgtttttcttctaatttctgcttctgatagaaaatagtttagatgagattgttttaaatgcacaaatggacaagaaatctactgtaatataaagccctgtccaaattccagctcttcccttattagctatgaagccttaagcaagtcattgacctttttggagctcagtttcctatatgtaaggtgaatgtgataatagccgttatttaatattgttaattattaattgaaaagtttaatggaaaatgtcttgcacatagtaattattaagcaaatggcaaccatttgaatcttcactagaggctattttgtattctaagtcaagaaatatattggataagaatgaaattaagttgactacagatgaacttttgatgtaagtatgagcctatttgttctaactaactattcagaaattggggcagtgtaattcttaagtacaatttaagatgatcttttccaactctcatatttaaacaccaggtaaacaacattaggagtggctgtagtttgttggttgccaactagctggttagtggcagacacagatttgaacctacatgtctgttgtgtggataaagttttcctcttatatcctgtcacttatatgttcagtttcccttgtatcttaaaattttatgaggaattaattatgcttttttagtatattcttcaagtccattatcaatttcttaaagacacaaactggttattatactgaattcctactcttctcagcatctcaaaatgtaagttgcacaaagctaataggcatttttaagttgattgttagaagtagaaattattataagtaaaaatcattagaaatatatttctgattttacttacattttagtcaatattaaaattaggagttttaattaggaaaattaagaaaataaagacggtgattttctcatgaagttgactcatatcttttgtacctgtctcctttccaaactctgaagtataaaaaaggtggaaaaggtggttttataaaacaaaacaaaacaaaacaaaaaacaaagaaacaaaaaaccttacaagttaattcagaggtctaaaagcaaaagcttgatatctgcaacaggagcttgatgtacagaaactagaaggcaacaaaggtcacactgacctattatttaattagaaagaacaaaagttttctcaatgaccctaacagttctttaaactgaattgaagatgctggtagactgtaactttcagcagatcgtcgtcagttctaaggttatttcgtcagttctgttaccattacagccaagacatcatacgacagactacttcaaatctcacctctacttgccaaatccgggatgagaacaggacaggtgacacagcagacggtggcttctccacgctcatggttggctgaagttgccttctagatgggctttcctttttataaaactaaacagcatatcacactggaaattgtttttgccttgtagatatatctggtaacaaattctgacatattggattttataaattctatttaagccttacaggagattttaagtttcctaaaattcttgctgtgttcattcccaattatagactagtaagtgttcacacagactctaacgagtttttcttactgagaaagggtgcacaaactcataatgggggagaatagtcaagataaaaaatgttggcatcagtaattaaacaggtttgctttccctaatgccaaccatggtgggtatttatttcctctttattttgaagaccacatgttagactgtcttttagtcaggtaagattgctgtaacaaattaccatagattgggtgattgtaaacaatataaatttatttcttatagttttggggactggaaatctaagatcagggtgctagcatcatcgagtttgggtgaaggccctgtacaaggttgcagactgctagttccttgttgtatcaccatatagcgaagagaacgagctagctgtctggtcacttcttaaggtgggactaggctgggcgcattggctgacgcctgtaatcccagcactttgggaggctgaggtgggtggatcacgaggtcaagagaccgaggccatcctggccaacatggtgaaaccccatctctactaaaaatacaaaaattagccgggcatggtggcacacacctgtaatctcagctactcaggaggctgaagcaggagaatcactggaactcatgaggcggaagttgcagtgagccaaggtcacgccaatgcactccagcctggtgacagagtgagactccgtctcaaaaaaaaaaaaaaaaaaaaaaaaggactaatcccattcataaggcctccaccctcatgacctaattaactcacaaaggccccacctccaaatgctgttttattgggggtcagatttcaacatgaattttgggaggggacaccaacatttgggcaatgagggattagatctactaaactcaaaaaactgtgtattgctattccaaagaatggtattttttcataattcttttttatgagtatgctataatatttacaatgtagcagtgactaatcaaaaacccacctgtccgacattaattcaggcatccataagaagagataatctgaactgtccctagaatacaaatcttgaatctgacaggtactatttcactttgggcaaactacttaatttttgagcttcaacttctttatccttaaagatgaaacaaagaaattcttcattgatagaaagaaaataatttcaacaagcattctgttgagtatcttatgaagtctcctcagctcagtgccacacttacctaatcctctcgattcgcattcggttgttctcttcccattccattttgtgttagtttcttatatggcacaatttccacaaacttatgccttagaacagacatttattattttactgtttttgtggaccaggtgtctgggcatggcctagcccatcggcgtgtcagcctaggctgtggtctgggctgagattcaggcttcttgtgcaagctcgaatactgttggcagaagtctttttatcgcagctatagaactcaggatggtttacttcttcagggatggcaggagagacagcctttgttgctacaaatctcaaatctctgtatcctcttttaaaggggtcatctgcctaactcaggcccactaaggatggtcactcttctgacctaaaatcaactaattggagacctgtgagcatcagttgtatgtgtccatttggcaaggctaccttcttgggttggccaatcaaacattaacttaggtgttgtatggaagtattttatagacaagattaaactccataataaattgactttatttatttatttgtttgtttgttttttccaagacatagtcttgctctgtcgcccaggctgaagtgcagtgactcaatctcagctcactgcaacctccgcctcccaggttcaagctgattctcctgcctccacctcccaagcagctgggattacaggcatatgccaccacgccaagctaacttttgtatttttagtagagatggggtttcaccatgttgaccaggctggtctcgagctcctggactcgtgatccgccaacctcagcctcccaaagtgctggaactacaggcatgagccactgcgcttggccacaaactccataataaatttactttaagtaaaggaggctatctccaatagtctagctggtcctgggcttcttcccaagagtttccagtctgcctttcctgacagcctgtcctatggacttcagaactgccaaatcatcccctacattgcataagccaatttcgtgaaatacatcttaatatttgtgtatcctcccgtgtgttagtcctttctgcattgctgtaaaggaatacctgcagctaggtcatttataaaacaaaagagtttatttggctcatggttctgcaggctgtacaggaagtgctggcgtcttctggtgagacctcagaaacttttactcgtggcagaaggcaagggaaatctgttttcacatggcgagagagggagtgaaagagagaggaagtgccaggccatttttaacaatcagatctcatggggaaaatatagagcaagaattcactcatcacccggggaagggcacagagccatttatgagggatccacccccatgacccaaacacctctcactaggccccacctccaacattaggaattacatttcaatgttagaatggcagggtagggggagagcataaatatgcaaactctatcatcctggttctgtttcttcagtgaatccctggctgatataggaccttaattacatatactaaatccacttactatgctgtataacataaccataatcagaaaagaaaacccatcatattcacagattctgttcaccctcagaagaaggggattatacaggtcacctgtcccagaggcaaggacatataggggccatctcagaattctgtcttccacatattctccaactatttactttttattttctaataaattctattcacggagaacaaacagtatgactttctgggatgggacagtaagaaagcagttggtaggggagggaagaggtcacataaataatggaattaaagctttacgtaacatagagattgagtaaagatataaaagctggccctttctgacaatcggagatccagttccccaaactcattagctgctaatctcaaagttgcttacttactatcattctctgttttctagtaggtagagttgtccaatagaattttctgtgatagaggaaatattccacttctgctttgttcaatacagtagccactagccatatgtagctatggagcattcaaaatgtggctatagtggctgagaaacagaatttttgttattaactaatttaaatttaagttcaattaatcatattgggatagtggctgcagtattagacaacacagcatagaggaataatctatcggtcacagctggatttctacaggaaacttgacagctttggctataaataagacctgtgatatgtctgcagtttcaacatttgttttattaatgtgtacctgacaaacaaatgacctgaaaatctcttttcaaccagaaacaaaatagactggctcagtactatgctttttacatattgcaattttatgtgctttgttttcactttaaagaaaatatattgtgcctatctacaatctcagagggaaattaggtatatagcatagtctcttttcacgtggaatcttttgagggggactagattcatccgaaacactcaaataaaaatataaatagacataaatgcagaggcagaaaaagcacattgcctgtcggggaaaaatgagctatcaattcttctgtagccaaaaccacatatggttagctcattttcaaggttcaaatgctctgagaagtgtcatcgtattaaccacacctaagaacggatattcggggaattctgagatcctaactgacagtctgatcagaagttgggtcctagagagctcagaaggactgttagaatgctgatctgatccagagattacccaatgctaggattttagtctttgatttctatatagcctacctgtggttccagggaatttgaagagctttgcatttgtcattaaactgaaagagtcatatagccttgccagggaaagaagacagggatgcaactgctgattaaggccccatgtttttatgtccttcttagagtacggattccatgtcaggcaactttaactagctttcacaaatttctcttgaatatactcatattgttggctggaaggtttaaggaattatttgagaaggcttctcatttacgatggaaatgtatcagaacatgatttaaaactaaatagcagagacctctgttttcaaaagaagcataattaaaggaaatttaccactggcagtgtgtgtgtgtgtgtgtgtatttgcttcactccaggcccaggacctgggtatatggtttggcctctctttttctcccaggacctcattatgtatccctctgtgtcttcaactctgtgggactcttgcttgacttcttccagctgtttcaccatagacacattccttttattttgctgtgtaaagcaattcaacccagccttctgactggtgctctagggcctataatttcatcggcaaatggcccatcaaagtgtttagttaaattttctccataacagaaattttcaagcaatgttttaaaatagtgactttttcttctttttaacaaataatgaagtgatacttttaaagttattcagctaacaggtataaagcagattatcctgcaaaaaaaaaaaaaagatgtatacattcctccaaccatactctgtgggaacagcagcaggactgccccgtgcatctttcagcaagcaggagatgcatccctctcttgtaccatttatattaggctttaattatctctctacataactgcagtccccaaatatgaaatgagttcctgatggcagaaaaagcttcatatcaatttttgtaaccccaggccctagtatgctctctggcacctaattatagcaatcagtgaatacttgatagggtcatcattcacttaacagatattccctggccacatatgagaaagtgacatttaagctgagatctgtaaaatgagtaagagtgagacatgtggaaaagaagatacgggtagttaaggctgagggagtggcacagaatgaatcaactagcaagttaatgaatgaccaaaaatgctggtctatgtagtactagacagaggatcacaaatatcttgtttcaagtcattcttgagagttctggccatctgtatcaaaaacttttgtttggtcataataacaatcattgattcagtaacaatgactaagaaccaaccatgtactaggggctggatatgcccagggtatcatgatgaaaataaaaaccagtctctgcctttgtggggagactgacattacagatctgcacagtggaggtcatattgcacctgtactcatcctggaggatggtagtgctctcaaggtaatagaagccaacggaaatgtgacttcagtagtgatctgagggagaacttctccagggaggtgatggctggttgagctttggaaagtaggtgaaggtaggaggaagggtcatatttcaggtaaacaaaagagcataaacagaactcttggggcagaaagacaaggctggtgtggctgcagcaccgagattgaagggtgatttggtatgaaataaggctggagagttgacaaatcctgcaatagatggctttttaggcaatgttcctgatttctggttttgattccattagaaacccaaagagatgccaccaaactatcttaagccaacagtttgtatgtgttggagtgatggacatggaggaagcatatcatgatcatgtctgctctgggtaagccttgctctggctgtggtgtagaggacaggtctgaaggcagaaagagaagacttggtaacacctgtcacaggatatgactgcagtgccagggtgagacctggcagcctagactaggatggtggtagcagagtggaaatatctgggaggattgaagagctattagaaggtaaaatctacagaacttggttgtgggttacatgtgggctgtggtggaaaaaagtgctggaaatgcctcccatgtgtcagtctggttttacctggtattgggcaataccatgcaggtatggactgatgggagagactcagatttaaagaaaggatcacacatctgttgttttttttatttttgaggaggtgaacttaacactctgggtctttatttccttttcttcctttattcttttttttttttttttttttttgagatggagtcttgctctgttgcccaggctggagtgcagtggtgtgatctcggctcactgcaagctccacctcctgggttcacaccattctcctgcctcagcctcccaagtagctgggactacaggcacccgccaccacgcccggctaattttttgcatttttagtagagatggggtttcaccgtgttagccaggatggtctcgatctcctgacctcatgatccacccgcctcggcctcccaaagccttttcttttttttttttttttaacttttattttaagttcaggactacatatgcaggtttgttttatggataagaaaatgtggtacatatattccacaaaatactatgtagccataaaaagaatgagatcatgtcctttgcagggacacggatgaaactggagagcatcatccttagtaaactaatgcaggaatgtaaaaaaaaaaaaaaaaccacaaatactgtatgttctcgcttgtaagtggcagctaaataatgagcacacatggtaaatgttgaatccgaagtgcctttacggcatctacaaggtgttgcgtggataactaaataaaggagtcaagatctcagcttggataggacaaacgacaaattgtgacttagctatgcataggagaggtaattgaaaccgtgtttggatgagatcacctaagggtgagaatagagggtgagaaaagaagagcatctaagactggtccttagatctaaaaataatggctgaataatggaacataagcttcaaagcagacagagaatgagtggcaggtaggtcaggggaaatctagaagggagatgtgacaagaaagcatgccaggaagacagaaatgggcaccagggatgagcactgctaagagatcatgcaagatgaggactaaaatattgtccaggaaattagtaaaattgaagttgttggtgaccatagcatgagttgtttatggaagggacggaaatttaaacctgggtgatgtgaatggagtatggggatgaagggtggggttaggagattgagtcagaaaatgcagtgtggcatttccaaatgaaacacagcatcagataataggataaagatgaggcatttcatttgttcgctcttttaaacagcctgcttttggaatcaagatggtgaattcaattaacctattattatttcttggtatatgacagttcactagctattgcactccgtagaatttatttcattctattcaccctggctgaagaaccataggtaagatccaacattttcagtggcagcccctcaaaaccaacgtgtttccctgataatcattctgcttcccttcttttgttgtttctggagatctccatctgctcttccatttatcatctgcttgatattcttggatggtgtgcttggttggcctatgctatgggttcagataggcaagtaactatattccccttccccattacagatgatgtgcctcatttagctatgataaatatttgctcatttcctcacatctgcatatggcactgctaccaatccatcttttcctccccatcctcatctctgctaagttcttttcctgccaccatttctatggttgaccagttagcatttaagaaaatatgctgacagtagccgcatcatggattagcatttcttcatgttcataatgcaaaagccccattagatgtaaaaaacttgctttcttatctttcctttgttacacttatatggaaccttttagaagttctatttataagtagaatgatatgaataaatagaaatgtgccagtgaaatagaataggccaaaatatacatcatattaaaaatgaaaatcaatcatttaaataatattatggctctttgaaataatattataccctatatcaggaggtttgtgttttgtcttatttcattttcagtatgtttctattgaaagtgagattgccatcaagaattctcaaaaccttctggggtgagatttcagagcttcaactatgttaatagctgtgcttggcatatctaatggtgttttgctccttctgaagcattttttttaattagacaatacatttataaccaagctcagtgagggtccagattgtggatgaggattaaattgagattaagatataagtgtctggtccattttaggaagttgtcaaacaccgttaagagtacacagtaatgttattctctgattgttgaatataggcaagtttcaaaaggacccttcacagttatgaaacttttaagtttgctatagtgaaaagattgatacatgggaataaaaattcactcatgaatctcattttataaataaatgcttcatttatgtaaattgtttgtactttgtgtgggtaaacaatattgattgcacatctagttgaaattactggatgagaagtattagtatcctattcttatgtgtcgatttaacctacagcctgggttctcttgactgccacattcctttaatttcctttacttttatatactcatttatctagaacttaagaaatccccatggcttgtggtaacatgaactgaagatggtattacaacacatttccttctagctctacccagcacgaaagctttattataaggattctggttcttcttgctatttggggagtaatattttgaaaattcataagattatgtccatcaagcattccagactaacaataataatagtatatgaatgtatgaaataccataacatttttaatatgatatttttaaatgaataaatttcttcttttttcttttttttaaattatactttaagttctagggtacatgtgtacaacgtgcaggtttgttacatatgtatacatgtgccatgttggtgtgctacacccattaactggtcatttacattaggtatatctcctaatgctatccctcccccttccccctaccccacgataggccccagtgtgtgatgttccccaccctgtgtccaaatattctcattgttcaattcccatctatgagtgagaacatgtggtgtttggttttctgtacctgcgatagtttgctcagaatgatggtttccagcttcatccatttccctacaaagaacctgaactcatccttttttatggctgcgtagtattccatggtgtatatatgccacattttcttaatccagtctatcattgatggacatttgggttggttccaagtctttgctattgtgaatagtgctgcagtaaacatacgtgtgcaagtgtctttatagcagcatgatttataatcctttgggtatatacccagtaatgggacagctgggtcaaatagtatttctagttctagatccttgaggaatcgccacactgtcttccacaaaggttgaactagtttacagtcccaccaacagtgtaaaagtgttcctatttctccacatcctctccagcaccggttgtttcctgacttgttaatgaacaccattctaactggtgtgagatggtatctcattgtggttttgatttgcatttccccgatggccagtgatgatgagcattttttcatgtgtctgttggctgcataaatgtcttcttttgagaagtgtctgttcatatcctttgcccactttttgatggggttgtttgattttttcttgcaaatttgtttaagttctttgtagattctggatattagccctttgtcagatgggtagtatttttaagtgaataaatttctaagtgaaatcagttatgactttcaaagcaatttttaatctgctgcatttttattagtgatgaaaagtatatgagttttaatcatgaacacaatttaaaaagtcaaccaaagacttcaggatgttgttccttgttacttctgtcagtgtaaatttcattaatactatgggtgatgaataatatgcaatgtttaagctgtttatattttctactttaatagacgttctggctttactatcaaaaagaatgcaagatttataatttagaaaacaagaagaaaaagagcattgtgaaggtcaaactagctatttgcattttaaaatagctacttctcttttaatggacgttgctacaaatgtatagcaataacccctcagctggcaaataaggaacattgtattagtttcctgagtttctttaaaacacaactgcttcgtttcctcccacagatactatggtattagatgttttaattgaattacttagaaaatatatcgtttagcttcttaatataaaactaattttaatctgagaaaatttaaaaaagtattttctcatccttaaattcttttttccattgttttccaatttagccctattgtgtctacaactcagattttaatcttttttttactaaaacaaatttattatttaaaaaaattaacttttctttttttccttataaaagtaacctacatttgtatctttagttctaaaattacaggtggccctaattcttttctctttggtatctggagaaagtgaatgcaattatgattagcagaaatgcttttttttcaattgcacactttatttagtggaaacaaaagatgcatgtatgattcaacttcacaaaaggaaaagactcaaagcaacactggtgatgagccgtttcatattcttaggtagacgcaagatccccgtacttcctgaaaccttatctaatagtaaaatattttctgactgtttctccagtcttttaccactcttgtcaatggatacacaccaaatacataaataatgtatgcaggttcattttgggtaccatctagctacacagcccagtggagtggttgagtacaaaagccagcctagcttgaaatttcaagctttgacattttctagcttccttgggcaagttacttagcctttctgtgcctcagttttcttacctataaaatgagaataatgatagtaccctcataatagggtgattatgaggattgcatcaggtaactttgtaaaggttctggaacatatagcaagtactatataaatgtaatacgtatgcaattaaaataggcttcaagatacacagattacagataaagaaatagctgtagacagaacatatcactttattcactccacattattactttttacattttcaggcttcttactaccaactaacagggtatattattagttctcttgtctatgacatctgatataccttccttcctttcaaagagtgccaaacattttaaatgatacttacatttttctccaatgtatgctgcacaattaagtagattgatagatatttttcatcagcacaaagagaggatcgcaatacatataagactttatctctgctgcaaaatataccttgaaagaattacatgtataatgaaaataaccctgacaatgccaactttatctgcgaaatcactggccgttgactttctgtgaaagagttaagtacgttgctgtatcaaatattcagttactcattaattaaagtagaacaaagtcaatactttttttgttcagcagattaaccaaaaactaccatgtaccatgtttgcaatttatattcatcctataaactgcatatgcattaaacatttccatctggagccccgatgactgtttttctcccatctcatgcttgataagctgttactgattagacagggaattctgaagctgttgaaagcacagatttttttaaagctctatcaccttggtattctttatctcttaacagaccttgcttgatgcctgcaggttccattttggctgcaatccagataggaactataggtcccctggccacgatggtctaacacagacaacgttatttggtatctatctaattattcctccattaaaaaaaactctctatctagtctaatttctaatattgaatttttcttctttaattgtctcatttaatttttttttttttgagatagagtctcactgtgtcccccaggctggagtgcagtggtgagatctcagttcactgcaacttctgcctcccagattcaagcaattctcctacgtcagtctcccgagtagctgggattacaggtgtgcgccaccatgcccagctaattttttttattttcagtagagacagggtttcaccatgttggccaggttggtctcgaacttctgacctcaggtgatctgctcaccttggcctcccagagtgctgggattacaggtgtgagccactggcctggccgtcttatttaatttgatgtcaaaccttaatttagtctgtgacatactctgtaatataacataactagcatattttggtgcatggtgttttctaactattgttataaagattttacgcattttgactgatttaatcctcactaactgtgctacgaggtagatgttattattatccccatttagtaggaaaactgaggtcacagggaggttgagtaacacagctaggaggcagtagagctcagccaggaacccagagcttctaattctgggacctgtgctacctgccaccacaccacggcctgacagagctgtcttcatcccaccgttagtgggacatgcagtttgggatgttgctcccgtgaaaaacagtattcaaaagacccacagcctgactccttctttataatacacaccctggatagcattaggagatatacctaatgctaaatgacaagttaatggttgcggcacaccaacatggcatatgtatacatatgtaacaaaactgcatgttgtgcacatgtaccctaaaacttaaagtataataataataataatgataataataataataatgctaataataataaattaattataatacactccctgcctgactccttctttataatacacaccctgccactttgtgctacctgataggaatcatttaatagattaaaaatggagtatataatctgtgtgctattaataattaaaaacaatgacaacagcaaacacaataacaatcccatagctgctgtttgttgagaatccccacgtgtttgtcctttcacagtgtctgtaagccgcgagacttactgtcatgtgtcatcagcacctgatgagatattttaaatatcacttcatactgagactcagaaaagtgctctttcttgtaaaagggcacaaagttagtaagtagtagaaccagaattcaaagcctagtccttttttttttttttttttgcatagccatatgctctcttatatactaattggttagaaccctctagcttgaaagcaactcagctagccagcaaatatccccccaattaggaggtgactgatgtcataaccagattgctccctgttctctttttgtttgctataaacttgatcctttggatttgtgcatattctaaagatcaccctgtcaccatgcctggaggcaattaagtataagggagtagtgtttcaagataatctcccactgtgaaaacatgggaataattatccaacgtaaacatgtcatttcttttctaaattacatggattccttttttgcactttaaacctggattatacatcttactcaacttcgtatccagacccaggcatataccagccaggtgtatagcatgaacttaataaatgttgattaagtgaagagacttaataattaataattaactaatatatgatgaaagaattttaaaaattcacttgtttgtccatagtttcatgtagtcaacaaatgcaatcaaaaggccaatgatatccatgaagataacatttattttttaactaaaatcctatgttttctgtaattgtatggtagcatagaattttatatatataacatacattcatatataacatatataacatgtatatgacatatatataacatatatatctatatataaaataaatatatataaatatatatataaaactttgtgtcatttcaatcctgagctattttttatttttctgcctcatgtcaattagaatcagtctccccctttgattccagtcaattcaaccaccagtcgttttcctacctcttcctgacctcctcaccaatattgactctggctatgtatcctgaaaagtgagaaagattgaactgatatgaatgaaaattagaataaatgtaaaattcacacataatattgtttatttctcctcatatggtacacaaatatacacttaaattttatttcatatgacatcaacatagtgtatattcaacaaaatataactcctgatcctgtcttaaggagtatataatctaatgaaagattgaacacacaacagtgctaagaaccaacagctatgaagaaggtgcaatattcacaaagaaactgtctttgtgatttcaggtagtgctccttagtatcggattgttgagccacatttgaaagaatgattgtgaatttatgagaacatacaccaacgagtggacagtgggatgcctctatccagcaacacaggccactgtctcatagttcctcatcagctgctacaggattcactccaaatttcactataggacctgccagcttgtatttttgtctcttgagtctacgccaaaaccaaaactggcaatcccaaccactcatcacttaaaaactaagagattcttttttttttttttttctgagacagagtctcactctgtcgccaggctggagtgcagtggcgcaatctcagctcaccaccttctccgcctcccgggttcaagcgattctcctccctcagactcctgagtagctgggactacaggcgcaccaccacacccggctaatttgtgtgtgtgtgtgtgtgtgtgtgtgtgtgtgtgtgtgtgtgtgtatttttaatagagatggggtttcaccatattggccaggatgatattgatctcctgaccttgtgatctgcccacctcagcctctgaaagtgctgggattacaggcgtgagccaccgcacccggccgagattcattaatcttaaaggcttggtcaaagagcaagtattaaaacaggaatgtcactttcagtttcatcttgtgccgttggccattcataccttcctgctacatctgtacagtcttccacgcccagcttgtgcttctagaaggaaatcaaatgagacgatttgtatgctggtgctctgaaaaggagggagctagaggatcaataggctctagctaatagttttttggatccgaataataatgtttatagaactggaagactgcagtttagaatggtccttgatcacttattcattggtctgttcaagcaggaaatacaatggtttcattgagtgctaggaaaaaaaagaaaggtaaagggtgttgaattcagccactggctgggctttgaccagaagggaaaatcagggattggatgctgctatttaaacattagcatttacaaattaattggtaccacgaagaaaggaaaaagaaactgaaaactgtgattaccaaagaatagtttaggaccaacatgctccccttttctttacatttgcttaggccttttatcgctgcctctttgaactgaggctgagattcacttttttgtttataagggcttacttgttactgagaacagagccaaaatgggcttgcagcatctgctcataactcattaaccagaacttggtcgtgtgaccaccaacacttagatgcaaaggagaatagaaaactagtctgagttctgtagccacgtacccagctaaaagctgcaatttgtatcactaaagtaaagctcaccttgcgctttcattgaacagctagcagtctctgccgtgcgatttacttcctcgcccctagacaaatggaggagagaattcctcctcttctgtgctttgaaagatcacaattgtcataatttttaagaggaaatttaaaatatacatttaaggaaggtttaatctttagttcttactaaaaattctgatctgactcaaactgattcaaaaagcaaggaaattcagtttcctatatgatggaagtgtcagggtggaacagatctcaggaattagttgacccactgacctgatgctttgggagccatttgggagccattccggcatcactgcgtgtcctgagcctggctcccatcttggggtcaagatggccacaccctttcagttctcacagacacacactgcaatttccagaggcagggtgaggccatctgctctgccgccatgttcttctcaggaatcggcggccttcccaaaggtgttctcagcacgcctctcatcctctctcgctgtagctgagtcacatccccatgtttcatccaagtagcggcaaggaaatgggattgcctcggttgacttggatagttcaggactggctcccttgcagagaaaagagagtcgcttcccttgaattatatgaggactggatggacactggacacccaatgagtaaaatcaaggcttgtctgaggtcaacagtaacaccaccaaaagcaacaaagaggaaatggatgttaggtcggcaaacactgtctgctacagttcataacgtagtttcgagagccttcaaaagtattaatgacaaactaacgtttggaatatggggaacactgtattttgcttctagtgatttggagaagtaggcaataatgtcgctcacctctactaaatgtatattgtaatgtgtacattaaatttaaaattgtacaaatgatttctcatcctcaaaagactaactcgttttcaggttaaaagtaaacatcattttatatatatatatacatatatatatatgtatatatatatatacacatatatatgtatatatatatacacacacacgtctataatgctatatataaaaaatatatctgtatgtgtgtatatatctataatgctatatatacatatataatacatattatatatgatacatagatatataatgtattatatatttatatagcatgtgtatatacatatatgctatatataggattatatatgtgtatacacatatatgtatatattatatatacatatacacatgtatgtacatattatatacatatacacatgtatgtacatattatatacatatacacatgtatgtacatattatatacatatacacatgtatgtatatattatatgcatatatacatatacacatgtatgtatatattatatagcattatatatagcattatatatgtgtatacacatatatgtatatataatacatatatacataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatccatatatgcataatgctatatatgtatatataatatatgcataatgctatatatgtatatataatatatgcataatgctatatatgtatatataatacatatatgcataatgctatatatgtatatataatacatatatgcataatgctatatatgtatatacacatatatgcacatagcatgcttataaatgctctatattgtatatacatataatactatatataatatataataatataataatatatacatgtatatacatatgtacatatagcatatataatgctatataagcatgctatatgtatatatgtatatacatgtatacgttataccatatactatataatatatagcatatataagcatgctatatgtatacataatgcatatataatatataatgctgtatgataattatatataatgtatataatatgtgatatatgatatataatatgtaacatgatgatgtaatacatataattttatgtattttattatatataatttatatatatgctatgtataggcacacacatatagtgtttgtgtgtgtatatatatgtagcatgaggttgtgagctagtcaaactttagtcatatcatttaatatctcaagtttacattgatgaaatatttataatgaaatcctttgctacccactaactctgagaggtttgagtacttataaaatcaggcttatttttttctcaaagttgagaaaagcattttttctccaagttagaaaagcattttttgttgtttattaataaaccaatcaaagctgatgtcttttggtttgagaaaaacaaataattttcttaagaaaagtgtgatgaaaattatagcatctttaatgactttgttctccatctcctagtattgttatctttgtatgtatcccttttgcctgggctgggaaaactgtactgtaggtcaggggttcccagcctccaggccacggacctatactggtccatggcttgttaggaacccggccacagcatcagaaggtgcccagtgggcaagcgaatgttcccacctgagctctgcctcctgtcagatgagtgcccgcattagattctcataggagcactaaccctactgtgaactgcacatgcaagggatctaggatgaacactcatgagaatctagtgcctgatgatctgaagtggaacaacttcatcccaaaacccacccccaagcccaacctgtccgtggaaaaattgtctcccaaaacactggccctggtgccagaaaggttggagatcgctgccataggtgatatctctcctagaaccatacacctctggttttaagagctaaaaacatacagacttattctgtaagtgtaaacattttactgtgtgttacctggccaattcttcacagctgatcattgtatatttttaaattctcttcatgtctcatcgttttattagcgtgtttcttcccattatgccattctgaaatccttttacaagttgtcctctggtccagtgatctggtgatacaaatgattgatagcaataaacatatcatttgcatctgcaacccaaatgtcctgtgtgttcctgtagaaattatgtagctaagacacgcacacgaaagctctgtaagtcaaagagtagcgtcgtgtttttccaaataaatttttctttaaaccttggagcctcattgaagcacaacttgaaatggtagaaaaacccagtggggcatgtcaccaaaagcagtttcctaccgcagcttccaagagaacttcattagtgttttcaacctgaatactaatcaatggcataaactctaaggaaattttaatatgaatatttttaaaggagcattttaatgtgaacgtagtgaaaatacaaaatcatatttaaataggaaagaaagggatatctctgggctcaatgagttttgaaagaggagaggtttgaagaataaatgagtttacagaaaataaacaaaaatatgaaacaaagaagaaaatagatacagagaagcaaaagtataaaaatagcaacatttaaaatttttatctatgctctttttgatacatccacagaaaatatgtttctctttctttttcttttcataaaatttatttttatttttaatttttttaaattacttttttgagacagatttctctctatcacccagaatggagtgcaatggcatgatcatggctcatggcagcctcagtttcctggctcagtcagtaatcccacctcagcctcctaagtagctgaaaacaggcatgcaccaccatatgtagctaatattttttaaattatttctgtggagacagggtctctctatgttgcccaggctggctcaaactcctgggctccagcgattctccaccccagcctcccaaatcgctggaattataagcatgaccacctagtctggccatacagaagatacataatcttagacccccttcctcatgtaacatgtagcactttctctaactatatcaaataatgtctgggaaacagcaattttaaatctttagtatggtataattattgtcaaagcaaaacaagatgaaacttcagaaaagtctagtacagagcttcaacgaattcaagttaagttttacacctgttactccctgatacttagaaaagttttatgcttgcctctattgtgcttagagagaatgttgtggtttgtaggaaaatagacactggtaagtgtaactgtatctgaaatttgcacacttcaccagtgtgtctggttattatctacatggtggaccttcagtgactggaggacctctctttccattcaagctgtctttttattaaccgttctctggggcctcaagttccctctgcagcatttatttccctttgagttaagtattgttcccattattgtcttagaaacgttaagtatcattagatacagtatctcattgtggattatgttatcagattctttgcaatgtgtctcttaacaaaaggatattgagtggcagagtggggagtggaaaatcactgaaaaaagaggacaccgaagagacacatgaattttctttgttctgttttttttaaccagtggtcatccctagcaaagatgtgtgtaagtgcattaaaaacatttgtgtgtagcgaaagtggtgaatttctctatgcaacatatttaaaagtcattgtttgtacctcacttgcatggctatttggccctataaatattggctcttgtctaatgacattttctatttcactttttaatagaatttgctgtaaaatggatactacagaaacagcattttattttcattcttggcaaaatcatttccacccaaagtgggggagctcctaacaatggttgcttctactttatttataagaaaaataatcaaggccgggcatggtggctcatgcctgtaatcccagcactttgggaggccaaggtaggtggatcatatgaggtcagagtttgaaaccagcctggacaacatggtgaaaccccatctctactaaaaaatacaaaaattagctgggcatggtggcgcacacctgtagtcccagctacttgggaggctgaggcaggagatccccttgaacccgggaggtagaggttgcagtaggccgagattgtgccactgcactccagcctaggcaacacagccagactccacctcaaaaacaaaaaaacaaaaaaaacagccatcaagcagacatggtcatcttttgcctgtagtgcaacagaactgtttaaaacacagtttaggccttaacgtggaaattcttgcttgcagcttccactaatcaatctcgctaacctcaggactctaactttcattttcctaattcacatttcaaaacctttctaaatttcaagagggaatgatttatcaaatcatctaactctttcaaattttggagaaataaatctcacttggatcactaaaaataaagaaaaggatcactatggaataatgaccctttaatagaaaaagaaaatatttctaacataaatattggagcttttctgtggtagctgtcaaatccaggagtttggaaattggaaaactagaaattagaaaagaacaaaaaatagatgttttaaagttgcaaagctccttttctaaccttaaattttgaggttacaatcagtttaaattttaaggtttaaagccagtttctaaatcttaaaactatattatttacaagacaattcaagtgacaaaatacatagtagtcagtcataaactaaatcagattctaaaatattatgtcatattatgaagcagtatgtaactaaagggctggtgattgagccctgaagggccgtgtcaggtcttctacttgttttcaaaatcaaggctgaagctgggtgcagttcccacctgtaattccaacactttggaaggccaaggcaggaaaatggcttgagcctacgagttcaagatcagcctgcaacatagagagaccccatctctacacaaaaatacaaaaattagctggacatggtggtgcctccctgtaatcctagctactcaggaggctgaggcaggaagattgcttgagccccggagttcaaggctgcagtgggctgtgatcataccacttcaatccagcctgggtgacagagcaagatgctgtctccaaataaataaatgaaagaagaaagaaagagaaagagagaaagagagacagagagatagagagagaaagagagaaagagaaagagaaagagaaagaaaagcaagactgcttctcccagcaatttgttaggatcctggctgtccgcccaagatgggttagatgaatggctgacaaggaatttgttttctaccactgtcacatgggagctacattaccccagctgttgcccctgcagagagaattatctgtatgttccgtgtatgcatcccaccttttcaacatcttgtagcagttccacttgagaagtttcaagtgatcggagtcctggccctcccacttcattgtctccataatccctagcattgcacttctctgtttgtcaatgtctataaatggtctctttgcaaggcttctcatgctatgtataaaacctttataaatagcatccactgcgactcacacagagccacttggaaaaacattcttgtcttgtttttctcacatatgtctaaaattttacactttttcctttatttttacttgatttagctaatttattcttaaccacagcattgtggtttagtaattgagacattttcttcattttgaactccagagtctcatcaactttagtcatgaaatacaaaaattggaaataagtctttgttataaatctaggccttgggtaggagttaactaagtttggtagtttgaaagttatagaaaccaaagtttacattgaatacatacagccaaccaggtgttatgacactgaattcctatattcaataaatattagttgttttctgggtggcaaattcataagctataaagaaattctggcttatattatgctgatgtggacagaattacagatgatggacttgaaggtgttcatataagcacccgtcctcactctgcaccaaaggtgtctcagggcctagtgagggggcagtgccagaagcctccaaaatacttgtttctctgaaatgttcttcagtacagaaagcagtggaagcagagtagactgaattatgtattttttcagctttcactttatgtctctacagtttgctctcttcctcactggggagaaaataaaccagctacctcagggaagtcagcacaaatacagaacagtaagggagggtcccatagtcaccaagcaagacgcccaatttgtcctaaatccattcatgcatgttatggtaaaaatatggccctgttctccttccaggcatgagtcaatgttgctaagtgggtggattagaatagtcattatttcaaatcaattagacaaatacttaatatgttgccactccagctactgtgaaccagatcttgatttagtaaagaagactgatatagaacatataagcgtgtgtgtgtgtgtgtgtgtgtgtgtgtgttacaattctctggtatttacaacaagggctgtactgttgtgctaggctaaatattagcaaaaagagagggaaatatgacatgttttacctgaatgggattaaatcttttattttacacttgctcaaggtcatacatttattcttactggtcccaggtaactgcagccatgaatatttttcttaatttattcagatacttttttaatgttctagaattaaaataatttaatcttcagaaatgtgtatctcttttagcattatcaagcaactaagaatataagtaataattataaattgttgtgttagattttacttctaacaccttccaattgtttattaaaacaattgatataattattctttgtaaaaattaacaatattgacaattatatgtggtttttaggatgtaatatttttgctgcaattggctaattttgatacttttcttacataaattttaagtgattgtccagtcacccgtgaaagcgtttcaatgtctgtggattttatgttttaaaattgcatttgaaatagtccaattcataatgtgctaaaataatcaagaaatgttctctaaaatcctgaattcttccatttaggatctaacttaaaattcaaaattaaaaataaatgaaaaattaagcttgggcaagtcaatcagaataagagatgcttaatttctgtagttgaagggagaaaattaaagtgatgtcagctttctcatgacccaagaagtatgtagttgaatcaatagcatcatgaacgccccatcggatgatcatggagtctcttagattcctcgtccccttccttctttccttaaacagacccagaaagtgaatcggtttcctcatgggcaaataaaccaagcctagatcctgatctctgggctcagagccaatgctcttctgtatcctgatgggatggtcatgatgctattgactcaactacgtatttcttcggtcatgagaaagctggcatcactttaattttctgaaaaatgctctgcctcagcatgctctttgtcgtgccaacccttggaatgaaggcatgtgctatgattctaagtttatattaaagaaactcaaccatatacttttttcttttttctttttttgagacaagagtctcgctctatcaccaggctggagtgcagtggcacgatctcggctcactgcaacctccgcctacggggttcaaaagattctcttgcctcagcttccctagtagctgggactacaggtgcgcaccaccacacccagctaatttttttttttttttcttgctctgttgcccaggctggagtgcagtggtgcgatctcggctcactgcaagctccgcctcccaggttgaagccattctcctgcctcagcgtcccgggtagctgggactacaggtcccctccatcatgcccggctattttttttgtatttttagtagagacggaatttcaccatgttagccaggatgatctcgatctcctgacctcgtgatccacctgtctgggcctcccaaagtgctgggattacaggcgtgagccaccgcgccaggccattttttgtatttttaatagagacggggtttcaccatgtcagtcaggatggtgtcgatctcctgacctcgtgatctgcccacctccacctcccaaagtgctgggactagaggcgtgagccaccactcctggccaaccattgtcattttaaggacttaaccaccctactataaatagcacttgtaacagcactatatctgtcatgccttgggaaatgcataaattgttaagattgacctaagctgtaaaaatgcaggaagttgaaacacagatgtgtaggcactgtatcaaatgtatcctgtttccaagttcagttcctttcccaatgaccccctcaaaaatgtttttctaaaattaactggatttgtgatatatctgtccttatattttctgaattcaaaataatttccttcttgaagctacagaattctgcaactttgcaataggtttctaatatttccaatatctcaggcctttattcaaaagaaaatgccagatcttttcaagagaaaccctgaatttatgttagaaagagaaattcaagctataaattgtacaaaataatatctaaaattcttatagtataagaagtcaacttcaagcttatttatagctttaaagtaatttagggtttagagagaagagagattaatgttcctattctagtagactcaataaaatatttgtttttatgttgcaatttttaagcagaatattttctacaaagtcaggaaaagtaggcaatcatcaaatagctttaaaaaattctgagcttcaccatagagggaatgtaaattgaaaaatgtgatttggattctgtgattctttaggaatctcagattctacatacctctgtactacaaaaactaaacttattgttgatatagtggttagtgaattttaataattaggtatataaaccacagtgtttagttgcagcaagcatgtcaggaatgagtgattggcctttgtatgttctacttgtaagttgcatgtactaaatggcacgtccatgctgtggaaggaaaaggggtatggccgggcgcggtggctcacgcctgtaatcccagcactttgggaggccgaggcaggcggatcacgacgtcaggagatcgagaccatcctggctaacacggtgaaaccctgtctctactaaaaatacaaatacatatatatatatatatatattagccgggcgtggtggcggatgcctgtagtcccagctactcaggaggctgaggcaggagaatggcgtgaactcgggaggcggagcttgcagtgagctgagatcgcaccactgcactccagcctgggcgaaagagcgagactccatctcaaaaaaaaaaaaaaaaaaagaaaaagaaaaggtgtacgtatgtcagatgatacaatgcagcattatacttatttttgaagagatttgctgtttgttaatcatttgcctcaagattaaattaaatatttattatattctgctgacatatatgtggtagtttgaaatggttctctactttcttgtgtaaaggtaaataaatgcaacgtaaacacaagcagtcttcattattgatagtaattatgtgctataaagttgccaggaacactgatttagcgaatactgaattatttctcctaggggaagtataggtttaggtttcagtgagcctctggtcactacagtttttgagaggacacaaacactcataccgtagcgttctgccccaaaaccccaaaattcacacaattctcacacacaaaatgcgtttattccatctcaatagccccaacagtcttaattcatttcaacatcaattttaaattctaactccaaagtctcatctaaataacatctaaatcagatgtgggtgagactcaaggtgtgattcatccagggcaaactgctctcctgctgtgaacttgtgaaatcaaacaagttgtgtacttcgaaaatacaatgtgggacacacatagaatagacattatcactttaaaaggaaaaaaaataggaaagaagaaaaaggtaacaggtcccaatttaaagtcccaagccccgaatatcctgccacctagatggttctctgcagtagccccacctccatggtggctctgtgcctgggtcaccagctcacggctctttcatgctagaatcacacactggtggcttctaccggttttgatggcggcaaaacttggggcagccgcaaccccatggcacctctatacattgccctagaagggactctgtggagatcttgcagagcaacagatctcttcctgagttctgcaacttcccagggcatcctcatttctgtctgagacctcatcggaatggcctttatcacccaaatttctatcaacattctgttcacggccacttaggtataccttaagaagattgaggttctttctacagctctcctcttttcttcttaagtcctcaccagaattacccttaaaggtccattcagaataatgtagccttttattattattattccttttttttttttttttcttttggagaaggagtcttgctgtcacccaggctggagtgcggtgccgcgatctcggctcactgcaagctccgcctcctgggttcacgccattctcctgcctcagcctcccgcgtagctgggactacaggcgtccgccaccacgcctggctattttttttttttgtatttttagtagagacggggtttcactgtgttagccagtatgatctctatctcctgacctcgtgatccgcctgtctcggcctccgaaagtgctgggattattattattatttttttaaagcatgaactttgtaagccttccagcctctgcccatggccatgctccaaaaatgttcctacgtttttagtatttgctgcagcaggactctacttgagtagcaattttctgtcttagtctgtttggcctgctataacagaataatataaactagatagcttataaataacagaaatctaattttgcaagttctaatgtctgagaagtccaaaatctaggtaccaagagatttggtatctgatgagggtccactttctggttcttagatgatgccttcttgctgtgtgcaagggcaacgcatctttctggggcaactttattttttttgtttttgtttttagagacagagtcttgctctgtcacccaggctggagtgcaatggcgcagtctcggctcactgcaaccttcgtctaccgggttcaagcgattctcctgcctgagcctcccgagtagctgggactataggcatgcaccaccacgcctggctaatttttttttttttttttttttgtattttcagtacagatggggtttcaccatgttggtcaggctggtctcgaactctttacctgaaatgatcctcccacctcggcctcccaaagtgctgggatttcaggcgtgagccaccgcacccagcctctggggcagcttttatgagagaactaatttcattcatgaggacttcaccatcataacctaatcacatctaaaggccccaactcctaacactgtaacattaagaataaggttttaacataggaattttgggaggacacaaacattcagaacatagcagttaataaaatatttgtaaaatttatatatgtatatatatatattttctttttagtaagttctatttcaaatctcagtgaataagtttcagatgtatgttgtttcattgtctttcattgtttttcttgcttctttctttttttcttttgaatctgacatcactacaatattgatttttgtttctaccttcattttataatcatataccttaccaagctacagaaacgaggcagaaaaacaatttccattttatttcagtacatcttcctaaaactggatcctggtttgcttagttgttattaacaacacttgatgagctattattaattaaataattatcttttatctcaaatgtggaggttcttgttcctatgaagcccacccttccctttagcagcagcaacaacaaaacgacaggcagcttctcccttcatatgggtcctgacagatgagccttttggacccctcgtaaaagtagtaaatgcacctttttcttttatttacattaacatttgttttttcttaaccatgctctctctattgatttagcattaatcatgttgtttcctacagaatttaccttttgaaaaataaaaacacaggcagatacatactggttattcacaggaaaattagggtgtaattattagcagactaattgtttcagatttactatgatccatgaagtcttgtatttgacagcttaaagaactatgtggccaagaagacataaatgtgggccagtagctagcagcctctgcataatacaactccaaatcaactggtgaacatttaaattggagtaatttaattaaaaatttgaatttctgggcttccttgaaaatgtattgtttgaataacaccagcattcctgcatatcataagttacctccatgtgaatagggacagccccttttatccacaacatatcccaaacactgcatgaatcctctgccatcatggctgagcttttaatctcttcattagaatctctttttggttgattttctaatcagggaaatatgtctctcttggtcatattgctatcaaaagtaagaaagtaaaagatcaatagaacgacatgatatttataaccagccagcatcacacatttgtataaactgcttgtcttctctgagcattgaagttgtgacttctaattttagaagctacaaatcattttatctctgtcaggactggttctcgccacaagttgtgtaagtactgctcatttatgaaaataaattaattcaacctcttcttcatggccccagtgagtgtgcaggtgtcatgaagtaatggacagcacccaagttcacagtgaatcagattccctccaatgcccaaatcactgaggtgtgttcacgagcagaccacagagtactgtttttagtgttttaccagacaggacctaactgctctagcaaagaggaaagagaacattatctcacaacatgtgtaccttttgagctttactaagcctattttatggttgaggtaaaattttcacccaaaggtatgtgaaatcaaaccaaaattacagaattgttgtaatatattgcaccatatgcataacctcaaaagatactgcacacatatgtcccaatctctcacaaataagagaaaatcatttgtaccaactaatttagctttcaggaaagcacagaaagtaaaataaataaaaatgacattttttcctaatcacctattacatattgctactcgtcctgacaaatttgtaggggttgttgatggatgtatagcgttcagaacattaatgattttacaagtttaaagtaatggtgtttgttcatgtacatatgtgtggatgaatagttgtatggatggatggatgatgtattagttggttttcatgctgctgataaagatgtacccaacactgggcactttacaaaagaaagaggtttaatggacttacaattcctcatggctagggaggcctcaccatcatggcggaaggtggaggggaccttgaacatggcggcagcaagagaaagaatgagagccaagagaaacgggtttccctttatcaaaccatcagacgttgtgagacttattcactcccactagaacagtatgagggaaacggtccctatgattcagttatctcccaccagatccctcccacaacacgtgggaattatgggagtacaattcaagatgagatttgggtggagaaacagagacaaagcatatcagatgaatttgaaaaggatagcgcatagaaattttggatagctaaagaagtaacaaactaagattctgtgtaaaaattaagatggtgggaaaatgaattcgaatatgtagcgtgtttcaaagaggaatttttgacattttgtttttgttttcagggtactgtcaatttcattttaaattctgaggctttgtaatattggatttatcatacacctggagtcagccacaactgtaaattttgatctgaaattcttcagttagtataaaatccctaactgctttgaaattctgtgtagtgataatgcatcatctgaatgctttgcatcctttaatgacataggtatcttctgaattctggctttgcgtaactgttgccaacactgtaagaacatcagctcgtttgaggctgggtctttgttctctctgtttctgggccctttccacgccctttctcctctccctcactagcacaggagttatctttccaatgcaaacctggacatgcattttccacttagaataccatcattacacacatgggccctcagcttcctcagggagcattaagtctttaatcttccaattctcaccctgcacatgaattgtaagccttatgtagtaaagtcacaaacaactgagcgtttttagaacagtcgaatgtgctattcccctatctgtctgaatttatcttactcagtcttaattctcttttcactggaaagttcctgtattgttttttgtttgttttttaactcaccccattacttccacaaccccagtcttgacacaatgttatggatgtagaagatacttcagagtccagaagttgatcttagacatttaataatggtttctaaaatttgctttaaaggagctttttgcaggtctatggactaacttttgccaacaattcctaggcttttgtttgatcaaaactgatttttcacttcttttctaagatatggtaaaataattttctgtactgagtgttttctaatatagtttattagtagaaaatttgagacacagtaaggccaacatatcagaaaacacctaccgtgaaaagatactaatattttattactttattaatactttatattattgatacgatatttataaccagccagcatcacacatttgtataaactgcttgtcttctctgagcattgaagttattttattttatataaatacaattattactttattaaaatacatgacatttatttactttattacttttattactgtggcaggccatcccacagggtgtagaccagaggtagggagctcagggaagcaccaggatctgtcaggaggtagaggggatgagggaactgtgggcaaggtcctttattgtagtttccatgggaagggataggtgcagcagggtaagcaggcttaggtctggctaactggaataattattccagtgagttctggggcacagaggctgatcctagttgtcttgtacctgattctgggatgaatagggaagacggatcatggtccagaagagagaaagctggataaaggaagcagttggggtgtggactctggattgattgctttatatttggaaagtgtgcttaccatctctagaaattggctaactctgggaagaccagtccctctagggtcagcaaggccccagatgtcaaagcattggagcacagagattaaaatacatggtcaggatagaggggaagttgaagccatggcagctccaagaaatgacacaggtggctgccattacccctgctcccaccctccacagctaccagcctccgtttactcatagggataattgattttttcctcaatattatataaattactatgaaaagagtgcctaaaaacaagttgcttatcactatttgtaactaaactgctatctttatatagtatcaaaatttggacagaacactgacaatgatattttaaatggaattagaaggtgaactgaatagagattttaaaaattccgaaataaatgttgggaataatttaaatcaaaagacattctgaggagtttcttgatgtctggtttctttcctcatctgtgtagcatttacttaggatttataattctagatagtcttttcgccagcaaaaaaactagattttgtgtggtcaaaagttgtagagctattttcagtaaacagcgaaggcgagaaggcgagtctaatttatttgactttttgatttacaaaaataaataaaaacagcttccacatggatttcctacaaatagattatatgctaattttcagaaattgttattatttctgcattattggatatatgagagttataaccctgcttagaaatagatcactctgattttctgatatcttgtgggtaatgagtggatgagagcgaggacagaatataggtgtgtgcatgtgtttgtgtgtatgtgtatggggggtgtatgtgtgtgtgaatgtccattttgggaggcatagggtacctcagtgggcttttttgtctcttcacgttgaataatgtgatatctaatgctataactttaaaaagttactaatattttcctgtgtctgttttttgtgattcattgggccaaccagatgattagccatttatggtttatcatatatacattttttatggagtaagtcaaaaattaaaatatgtaggagtcaattgatcttgcctctgaaaatcaataaccatttcagattagcatacaatgactgctctaaaaggtgtttaaaacttagtgactttaatcttggaatatgcaagttcctcattaatgcatttaattcaaaggaaattatatattctttatttaaactcatacaggagttcaatgttttggcctttgacttataaacaaataactccagtgtaagtataataaaagcatgttatgtttaaaccatttattcatatcagacactcatagttgtaagagttgtgtagccttaaatcatgtataaatctgtactcttagaaagtaaactgcacggtcacaggcatagtttagaggggaaataataacacagtggaattctccttttgccttgtttcaaacctaaatgatgtttcaatcagtttagaaagtgtttatgctgccaggaatccaaaacggaacaatccaaagcctgtatcctagaagagcttcaagtccacaggaaaaatcacgcccaaaagaagataacttcaatataatgtgagaagtaaaatgataaaagtatgcaaggaactaggggacaatagaccaaggctgtttcacacaggcaggctttctagtggtgaggcttatctgaggcttagaagatgcctaaaagtaaactagaacaagaaaaatggctgctcactgaagaaagtgagcatagcccgaggaaaggtgctatgtgaagtttgcgaggaattcaatccgtttaccatcaggagcacataaaaagaaagatggcactaaaaatgagcctggacgggaaggcaggagctatatcattgagggtggtataggccacactgaagaacctggcttttgatcttttttggaaagagtttatttcaaaaaggtctttccagcttctgtgtgatggttttaagacgggagagttccctggaccccttcacgggacttgcaacaagggtgtggctccatttctcgctcaagccccttttgggaggaggagcatgcaggtgagctggagcgagcgcttttgggccctggctccacggcagtgtctaggggtgttgcagtgctcttttagctttgccatctgtggatggttaagtgttaaccagttcagtggagagtcagggtgacagccttttataccctgtcctcttgatacgcaggtccttgtctggcattcagaaagaatcaggtcacatggacttgaaggatggtgaatgcagggattttactgagtgatggaggtggctctcagcgggatggatggggagctggaaaggagatggagtgggaagatgatcttcccctggagttcaaccaccccacggccattctcctatctgactgtccccagccaaacccctcttgatgtacagacgcttcctctcttctctccttctctgctgtgccgctcttctgttctactgctcgtctgttcatggagcctggggtttggatttatgagtataggatggggagcacggcaggccagggtggttttgaaagaagcaacaattgggcaggaaaacaggataactgttctcatttagcaccacggtttgcgggcttgagggcggagcctttgccggggaaccaccctcttgtctcctgttcatatcagttggatttaagagaaataagaccaaaggatgagaattggtcatttaacaatgttaatacaataggcaacatgtgaggtaatggtaggctcatgatagtacatataaaagtaaactatgagttttaaaaatatcaaagtgaaatatcaaattgaaatatcaaatttcaattaacaatcattgcacctcaaatgaactcattggctatatgatactgccactgcacaaagctctatatttcacaggtcttggaagtcgctaaatgtaggtaggcaaaaagaaaaaaaaaaaaaaagaagctcaagaaagttccagatctctggcttgagtgactggataatggatataataaaagtagtggggcccagagaaagaattatatgttgagcaggtagagtgagatgtgcctgtggaatatccatgtggatcagccttccaagttactggattggaatctaaatggtatgcagaaatgaaatcagagtcctttgatattgttgtcactgtcctagggaatatcaagcactgaaggggaaagcaacatattttaagcagaaatattgcacaaactgtgagatgctggccttcaggaaagaagagccttgaggttttttgttttgttccattttccccaaagtagaagtgattttcagattctatctctagatcatttttaaaggatctggagaaggctcatttgctactattactctaaattagctataatgacattttgaaattattttatctgtttaggtttatatcatagatacattgaaaaaaagaaaggcagtgggttaggaggaagaaagtattcagataaaagcaatgtgtagatggaatgagattgagtccaccagagttgtgtctgttctaggactgagtcaatttaaaataatggaatacattcttgcccaccaccacagctccccaaaagtaacctaatgttaccagtcttttcatctgactattgaaacctcaagtatatttgtagttgtagcaccaagatgggtcagcgagattcttgaaatttcttccaatctagtgactctaattttttaatgaagtatgaaataatagtgtttattataccttaatccaattaatagaaatatgagtgacaacattcacacattctacaaatatttaataaatattcactgtttttcaggcactgttttaagtgctgggctttagaatggaacaaaactaagtctcagaggagatatgctgtaaatatacaaacatcaatgtatcaggtagagataaattccataaaaatgaataaagctgcgtgaatagagaggaggtaaagttggcagtcacactttttataaagaatgatcaatgtatctaaaatattgacatctgacaatgaaaataatacacagatttgcatgtgtgtgaaacttgcaaaataagcaaattctatcttctagtatttttaaacttcagtttcagaaatgaaatgtatttcaaactcttgaagtgacttggtatttatttgcataaactatatagtattcgattctgtactaactggttaatatacatttttactatttttttagattcatatgctttatatgtatttgagaaatatatatgcttttacaaaatttaaagttccaaatttactagtttttaattagtttattttttataaaagaagtctttaattttgtttccttttttctctaaaaatctatataattttttacctttattgaattattatataattgaaaaataaaaattgtatatatttgagatatatgattccacaactctgtgatattctccccaaatatcaataatgcagtctagtcctaagaaaacgtcagacaaatccaaactgagaaagattctacaaagcacctggctggtgctcttctagagggtcaaggttatgaaagacaaggaaagaattggaaactgttgcagattagaagtgactagggaggcatcataactaaatgcaatctgagatcctggattgaatcctagaacagcaacaaaaaagtattagtgaaaccctggtgaagtccaagtataatctgtatttgagtgaatgccacttaagttagtattttcattttgacaaatgtgccaggttatataaaatgttaatattagaggaagctgggtgaaacatatgagaattctatctttccaactaccttttcagcttttctctaaatctaaaatttttccaaaataaaaagtttgtgaaaataaaaacaaaacttccaccacaatttttattgaagaagttggacatttaactaatggtacatttttagctaatcaaaatcctgttttagaaaacaaaattatgaaataaggtttaaaaaatgtacagtaacaaaaatcaaacacaaactatatacagtattatccatatgtgtatctatgtacatacgtaaagattctttatatgcaatttaaaataatcacaaatagtatattatcattggttatttcagtaaaaaatgaaataatgccttttaaattttttttctttaaacctttttgtttctttcggatcccctataaaagtaactgaaaacatttgatggggaaacggtattaaaagtaactcttgaatatttatttgttgatatgctatatttacatactttttaattttttcaaataagtagactacagtttcaaattatatattcttttataagtgtcttttattaagattaataaaaaattttaattaaaccatgcaatttccctgtactataaatattatatcaccccaaactcaaattattagtgtacattttggaccatgactaactgaaatgaaattctccctctctctctcccactgtctttattcttctcccttcctccctcatatatatatatatatatatatatatatatatatatatatatatgaattattccataccttatatagttggatagatatttaggtaaatatgtaaaatgtaggatatgcaccagttaagtacccattaacactggtgatttttcgtggttgggattcactctctactttctatatttctgtattgcttaatttcttttgatcaatagacatagtttgtaataaaatatatagcaaagatatcttttaaaattaaaatatcaaataaacttaaaattttaatattaaaatgtttatatggtaaacacttcttcaaattatcttattcaaagttagaaagtgaagactaaggaacaataaaatgtttttgaaaaagcgttttctaccatgatgatttgatgaattgggcatattaccagcttgctgagcttttgttaggaacaaaattgtggaaacactatgattttgcattcattttttgactagccattattgttcagattgcttaaacagttcaaccatacatatttaatcaccgcatcgaaaacttaattctagggagtgataagcaatcaggataatagaagaaaaaagtggcttgtccccaaataagcacagcgcattattagatatcaaatgaaattttaatctatttttgtaggaaacagagccaaactgtgatggatgttctttacattgttgtagaatatcccagactttttaaagagtacatggtatgtgttaaagtgtaaatatcatagattacttctagaaattttataattttcaagccagctctgagcttacatccacaagaggatgtgctgatattttggaagcatttaacccattcatagaataacaacttttaaattttgttttagatagatggatagataggtgggaaaatatgttgaaactttttctttttctttgtagggaatctaggttacagagaattttgtttcccagctgaccctgacaacttaccatttgtaaagtgagacttggtctacatgaatagctgtccttcctgtttttattaatatcttaggattgtctgaaaaaaataagccatcttcatcttttctgtcacattttctcattgctctaaaagtaagacaggaatgcattaacatttgcgtaaatcattactctgtacctagaactaaatgtgttttgatttagaagaaagtatagaggaggtgattcttgttccctgagtaaaagctcagggaacgtttacttcctgaaagatgaattagaaatattttatgtcaattaaaatatgctaaaggtgtataaaacaagatgtgtctattatttaactgtcactgataggaaattgactgcaaaactactgtctagagttcagaatttactgtcatctgtttttcttttattcacttttcaagataaaaagtatcatcaactgctggattatacgttctcctttatttctcattgcacatgaaaaagatattgccattgaaattcagctgtgacagtatataggattaagctgaagtttaattggctttgcagtgttagcagaagccaaaattaaacgattgattttttccctcatattaaaataaacctctgtgattcacagtctcagagaacagaattctgttgattaagaaagtctttttatgggcaataaagagctgattataagaattaaaatttaaagtttaaggtcatattttttctgaatgttttataatataacattgtacaaacttatttaaaagcataaatatttgagatactagcatagatattttcaaagtatgtgaaagccatcaatgatttgaaaggcatgcttagatttcattttattcgaagtaactgtatgcacaacaattcactttatagaattaagtaaactcaacacaaaaaaggagtggatgtggttctggcagccctgcatctctactgtggcccccaaaggaatttatttggtggtatgctccacttacaaggcaaaccaaagtgttcctcgtggtgattggagtaaacaagtgccagagaactaggacatgaaatgagaaaatatttctctgacaggctttaaactggctattatttttctccaatgtctccctctggagttctttagccagaccttacccaaaacctagaggctagctttgtccagacttgtaattctaaagttattagagctgttccgtttgactaggctttctatgatttaaaaatgaaaagcttacagaaatagtctattgaaaagatttttaacagtgaagatttgatcatggtaacgaagcttctatttgaactcaatatttgatttgaatggttacattgcattttgaatcattctatgaatcgagaatgcattgaccaatagtgcctaataaataatatcatctcatttttatttctggtgtgaaataaatagtagttatcaaatgaatcctcacagtcacatatttctgatcatatttcccattttttaaaaagtttacatactttccttattttaatctattcccctgaaactaaaattagagctgctgtagtcatacgctggatatttgttctttaaactcatatatggataagtgaagatatctgtgtccaatgtagtgaaaaaacaaacaatggtgcccaattctccattccaaatgcaaggaggtaataagaaatttgagacacactgcttcctaagaataaatggtaagaagtttctgaaaattcgattggttgtaaactctgaatactacaacaaggtttactaaaattgtggtgaaatataaaaaccatttaaaaaaaagagaatagcataaaagattacattccaagtgccttcattcttacatcaaagaaaacaactttttgaataaaatatatacttaaaatcatgaagaattatcattaaggaatcaaacatttaagtctcataatctgtttgagatttaaaaattttacgattttggtctaaactctagatttctaagttaagatttgaagcatataacccattgaatttatattactaattttgtaattaaagtaaaatgttcaactgatagagcttttatgagcatttttatcaatactctccataaaacctcctttaaaacaaacacagtaaatcaaaagaaggaatagaagaaaaacagaggactgtcaatttctcaagaaaaacacttacttaattctcatttattctttgcagacacctgttggaagtggatggtaacatacatggctgaactaatatgttatttttttttttgttttaggggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggtgtgttctgactgtcagttctattctttccgttatggatgttcccattaggaatatgttcatgttgctcaattctttaaaatgtaaattataaaaagagctcatgttatatttcaattcatacttaatctataacagtaggtatataatgaaacacctagtcattcaaaaaatatttattaaacacctctactatacaagttactatactagtctttggcctacagcaaggaacaaatagacaagatccttaagctcattaagttcatgacctaacggaggaatcagaccatatagcatttattattcttattttaaaacaactaagcaaaaatgaatgtcttcaaataatatatattatgaaccagttgaacagattaatatgataaagggactaggttaatacgtcctgttcaaaggcaacagggctaatattagaatgtgtggtgaagaaagactgctctggggagaaaatatttaagatgagatcagagtgatgaaaaggaattagccatgaaaacatgagagaaagaagattacataggaagagaacatggaagaccaaaagcacgctcaagaagcaggaaggatgccgccgtgcataaatgctgtgagttattaagacaaaagatgaagtccaagaggtggaaattgcccaaatcctgtgggatcctgcagggcattacaaattgtttagatattatttttaagaataggaagctgttggaagtcattaaactgtatggctttatcatcttattttttatcaagcgcattgagacttctgtaagaagaattacttgtgtagatatgagagtcgcagcagaacttctgcatagtttgggtgagagatagtactgcttgtatgaggtggttatcaggggagatgcagagaaatatgtcaattaaggaaataattttagtggtacattcagcatgacttatgatgggttggatatagcctaagaagaaaagagtagaaataaagaatgagccctaggatttgggcttgagcaccaaatggacattagtgccattttcagaaatagagaagactttaggaggaattctagagatcagtttggacatggttaatttgagctgcttatgaaacatctaagtagaactttcgattatggaagttgatatatgagactgagagaggaagactaaaatggagactaagtaattgtgaatattgagtaggagaaaatgaagaaagtgtagtatcacagaaatcaaggaaacaaaagaggttgtcaactgttgaattcatctaaatgtcatgtaagatgaagacagagaggcaaatattgggcttaacaacatggaggttactgttaatttctactctgtggaatagaaaagacaaattttgtaggtaaaaaagagaatgaaaggcgttaagtaaatattttgactaactagagaggaagaacagttagttaactgttaactagaaagaaagaacatagagaaatgaaatgttggctgctgaaagatctgaactcaaattactgttttatgtggggttgttgttatttgtatttatttatttatttatttatttatttatttatttacttatttttgagtcagagtctcaccctgtcacccaggctggagtgcagtggcatgatctctgctcactgccacctctgcctcccaggcttaagtgatgctcctgcctcagcctcccgagtagctgggattacaggcacctaccaccatgcccggttaatttttgtatttttagtagagatggggtttcaccatgttggccaggttgttttcaaactcctgacctcaaatgatccacctgccttggccttccaaagtgctgggattacaagccaccgtgcctggccctgttgttgtttttaaatggacaagaccaatgtatgtttgtatgttgatgatgtagctaggatttacttaaagctaaagtgaagatctgcaagattggtactggcattcaaaattacagtttaggcaaagtaatggtacctttttcttttttttttttaaatttaagttcatgaatgcatgggcaggatgtacaactttgttacataggtaaacgtgtgccgtgacggttgtctgcacagatcatcccatcacctaagtattaaggctggcatccattagctattattcttgatgctttccttcctcaccacctaaacctccgacagaccccatgtgtgttgttcctctctatgtgtccatatgttctcatcattcagttctcacttataagtgagaacatgtggtatttggctttctgttcctgcattagtttgctgaggacaatagcctccagctccatccatgtgcccgcaaaggacaggatctcattcctttttatggctgcgtagtattccatggtgtatatgtaccacattttctttacccagtctatcattgatgggcatttaggttgatttcatgtctttgctattgtgaatagtgctgcaatgaacatatgtatgcatgtatctttataatagaataaattatattcctttgggtttatatccagtaatgggattgctgggtcaaatggtatttctgcctctaggtctttgaggaatcttcacgctgtcttccacaatgattgaactaatttcccctcccaccaacagcataaaagctttcctttttctctgcagcatcaccagcatctgttgttttttgactttttaataatagtcattttgactggtgtgagatggtatctcattgcagttttgatttgcatttctctaatgatcagtgatgtagagattttttttcatgtttgttggccacatgtatatcttcttttgagaattgtctgttcatgtcctttgcccacatttttatgaggttgtttttgtcttgtaaatttaagttccttgcagaagctagatattagacctttgtcagatggatagattgcaaaatttgtttctcattctgtaggttgtctgttcactctgatgacagtttcttttactgtgcagaagcacttcagtttaattatatcccatctgtcaatttttgcttttgttgcaattgcttttggcatctccatcatgaaatctttgcctgtgcccatgtcctgaatggaattgcctatatagtcttctaaggtttttagagttttgggttttaaattaaagtctttaattcattttgaattgatttttttgtacagtgtaaggaaggggtccagtttcaattttctgcatatgactagccagttcttccagcaccatttattcaatgaggaatccttttcccattgcttgtttttgtcaggtttgttgaagatcaggtggttataggtgtatggtcttatttctgagttctatactgtgtcccattggtctatgtgtctgttcatatcagtaccatgctgttttggttacagtagccttgcagtagagtttgaagttgggtagtgtgatgcctccagctttgttcttttttcttaggattgtgttggccattggactcttttttggttccatgtgaatttttaaatagtttttttaaattctctgaagaatggtcaatggtagtttaatgggaatagtattgaatctatgtattgctttgggcaatatggccattttcatgatgttgattattcctattctccctatccatgagcatggaatgtttttccatttatttgtgtcatctctgatttctttgagcagaggtttgtagttcttcttaataaggtccttcacttcccttgttagctatatcttaggtattttatattatttttggcaattgtgaatgagagttcattcataatttgactctctgattgcttattgttggcttataggaatgcttgtgatttttatacattgattttgtatcctgagactttgctgaagttgcttatcggcttaagaatcttttgggctgagatgatgaggtttcctagttacaggatcatgacatctgcaaagataatttgacttcctttcttcctatttgaataccctttgtttctttctcttgtctgattgccctggccaggatagccaatactgtgttgaatagtcacggtgagagaaggcatccttgtcttgtgacagttttctgtggaatgcttccagcttttccccattcagtatgatattggctgtgggtttgtcatagatggctcttactattttgaggtatgttccttcaaaacctagttaactgagagtttttaatataaagggatgttgaattttattcaagaacttttctgcatctactgagataatcatgtggtttttgtctttagatctctttgtgtgattaatcacatttattgatatgtgtatgttgaaccaaccctacatctcagggatgaggcctacatgattacagtgaatacccattttgatgtgctgctggattcagtttgccataactttgttaagcatttttgcatagatgttcatcaaaaatatttgcccgaagttttgttgttgttgttgttgttgttgttgttgtatatccaccaggttttggtaccaggatgatgctggcctcatagagtgtgctagagaggagtccttccttttcaggtttttggaatagtttgaataggcatgttatcagctcttctttggacctctggtagaatgcagctgtgagtctgtctcgtcctgggctttttctggttggtaggctatttattactgcctcaatttcagaagtcattattggtctggcttagggaatcaatttctttctggttcagtcttgggagggtgcatgtgtccagaaattttccatttcttctagattttctagtttatgtgcatagaggtgttcatagcattctctgatggtacagagaatactataaaaataatagagaaatacaaacatatttctatagggaaatacaaatgtatttctgtgaggtcagtggtgatgccccccttacgatttctggttgtgtttatttgaatcgtctctcttttcttctttattattctagctaatggactattttattaattatttcaaaaaaccagtgtattaaattctcacactggtataaagaactgcccaagactgagtgatttattaaaaaaaaaaaagaggtttacttgacttacagtttcacatggctggagaggcctcaggaaacttacaatcagggccgaaagggaagcaaacacatccttcttcacatggcggcaggagagagaagtgcagagtgaagtcggggaaagccctttataaaaacaccagatgtcatgagaactcaatcactatgatgagaacagcaaggggaaccacccccatgacgtccctcccccaacacatggggattataatttggattacaattcaagatacgatttgggtgggaacacagagccagatcatatcaaccagctccaggatttattgattttttgaaggatttttttgtgtgtgcctctctattccacttcagtttagctctgatcttggttatttcttgtcttctactagctttggggtttgtttgctcttggttctctaattcttttagttgtgatgctaggttgctaacttgaggtacttctagctgtttgatgtgggcatttagggccacaaatttccctcttaacactgctttaactgcatcccagagattctggtactttgtatctttgttctcattagtttcaaagaaattcttgatttctgccttaatttcattatttacccaagagtcactaaggagcaggttgttcactttccatgtagttgtgtcgttttgagagaatttcttaatcataagttctaatttgattgtgctgtggtctgagagactgttatgatttcagtcctttttcatttgctgttgagtgttttactttcaattatgtcatcaattttagagtaagtgctgtgtagtgatgagaagtatgcatattctgttgtcttgggatggagaattctgtatatatctatcaggtctacttgatccaaagctgagttcaagtcctggatgtctttgttaattttctgcctcgatgatctgtctaatattgtcagtggggtattaaagtctcccactattattgtgtaggaatctaagtctctttgaagatctctaagaacttgctttatgaatctgggtgctcctgtactgggtgcatatatatttatgatagttaactcttcttgttgaatttagccttttaccattaggtaatgcccttctttgtgttttttgatctttggtgggttaaagtctgttttgtcagaaactacaattgcaacccctgcttttttctgttttccatttgcttggtacatttttctccatcctttattttgagcttatgtgtgtgtttgcatgtgagatgggtctcttgaagacagcataccattgggtcttggctctttatccagcttgccagtctgtgtcttttaactggggcatttaacccatttacatttaaggttagtattgttatgtgtggatttgatcctgtcatcatgctgctagctggttagtttgcaggcttgtttatgtgattgcttcatagtgtcactggtctgtgtatttcgatgtgtttctgtagtggctggtaatggtttttccttttcatatttagtgctttcttcaggagctcttgcaaggcaggactggtggtaataaattctctcagcatttgcttgtctgaaaaggatcttatttctccttcacttatgaagcttagtttgactggatgtgaagttctgggttggaaattcttttctttaagaatattgattattggcccccaatctcttctagcttgtagagtttctgctgagagggctgcttttagtcagatgggcttcccttagtgggtgacctggcctttcagcctttctctctggctgcctttaacattttttctttaatttcaacctcagagaatctgatgattatgtgtcttggggatgatcatcttgtggagtatcttactgaggttctctgcatttcctgaatttgaatgttggccttcttcctaggttggggaagttctcctggatcatatcctgaagtatgttttccaacttgattccattctcccggtctctcccaggtacaccaatcagttgaaggtttagtttctttacataattccatatttctcagaggttttgttaattccttttcattcttttttctctattcttgtctgcctgtcttatttcagaaagttaggcttcaagctctgagatttcttcctctgcttggtctgcctgctattaatacttgtgattgcattgtagtagtgtgtttttcagctctaacatgtcaattatattcctctctaacctgggtgttctggctatcagatcccatattgtattaccatgattcttagcttctctgcatggggtacaacatgctcctttacttcagtgaagtttgttattacccaccttctgcagcctacttctgtcatttcagccatctcagccttagcccagttctgagcgcttgctggagaggtgttgcaatcatttggaggaaaaggggcactcggctttttgatttttcagaattttttgcattgattgcttctcatctttggtgtcttatctaccttcaatgtttgaagttgctgatttggagatggagttttgtggggtttgttgttgttgttgttttgtgtttgtttttcttttaatagccctgtagaagtctggccactcatccatagggctattgtggtttgctgggagtccactcgagacactagttgcctctgtttttcctgtacctggaagtataatatcagcaatgaagcctgcaggacagcaaagttggcagcctgctgcttcctctggaagttccatgctagggataactgacctattgctggcccaagtgtgcctggaggaagtggttggagactactgttgggaggtctcattcagtcaggaggaatgaggtcagggattgacttaaaaaagcagtctggctgctttttgatagagccactgtgctgtgttggagatttcttcagcccctaatcggtttgggctctccaaggcccacaggctggactagctgagaagcctgaatgtccaagttggtgacctgccccacccttcaggcactttgtcccgtggagaacacaggcaggggtggccagaggccccagctgggacaacctgccctgggaagaagaatggatggggggatggggcagttaaagaaacagtctggtcacaccttgacaaaacagctatgttgtggtgaggaactgcctctgcccccatcagcttggactctccaaagcccacaggctgtggaatgactgaattgtccaaacaacccaggtggtgaccctcccctcccttggtcactccatcccagggatagaaaatagctctgtcatgcaggcaggtgtggttggagggccccagctgggaggtcccacccagtaggaagaatggatcagggctctgcttaaagaagcagtctggccatgatctggcaaagccactgtgttacgctgctggggaaaccttcctccttgtctggactctttggactctccaaagcccacaggctgcaaaggcccagtcgaccaaatagcagagatggtgtctgtacctctcctcgaggctccatctggtctcaagaaggctttgtcctgatgacagtggctggctgaaattccaagccagtgggtcttttcttgtagggtgccatggaaatggggcccacagaacaatgccattcggctccctggattctgcccccttcctaggagtatgtgcagacctcccgccttgcctgagttgcagacacctttgttggaaatcccagggtggagtttgtaaagctccaccctgtctctgtgcatgattgagcagttgttctgccaagactccacacagctctgtgtgtcagacccaaggctctggtgtcatgggctcacaagatctcctaatctgtgagttgcagaaatccatgggagaagcatggtttcttggggtcacatagtcactcactgcttcccttggcaggggttgggggttcccttggctccacgtcgctcctgggtaggctgtagccccatcctgctttccttcattctccttgtgtgaagttgtttccctaatccgtctccatgtgagaacctgaatatttcatttgaaaaggctgtatttactgatcccttccattcctctccttgagcactgcagacttcagctgcttctcatcagccatcttggcccctgtctcacctgtttctcttgattggctaaaaattctaggctatttgatttatttggcaattaccaatttgagtggtccaaacattcctgaatatgacttgtatctcatatattaacttttattactttgaaattcagtattatactaaaaattgcaacttcacttaggctatttttgtaggtaatgatacattaccttaaagatgtacccttgattataaaacttttcacattaaagatctgatctgatagacacaatagcttctataacaaagaagaaaagtcacacaaaattcgccatcacttagttacataaaatattattttttacattaaaataaaagtaacattaaaatgcatgcaaaacctgggaaatacaaatgtcaaatatactggtttaatataaatcatgaataagaaattataccactgcataataataccaagacattaggagaaaatataggcaaatgatatacaagataactcataaaagaaaaaaatattatataaacacccaatgcttaatttttatcaagtaagtaaatacattttaaagtgatactttcagtgttggtatttgacaaaatggatcctttgtattgttctgcaagtcagaaaatactttcaggaaaatagctagacagtatgtcttcggacacttgaaatctcttacaatacagtattttggtccaaaaatcataaggcaaaaaaagaaatgaccactaggatttaagtccaaatatgtaatttgcaacattaattacaatgtcaaaaattgggaaaaaattaaacacatagaaatatgttgatagcatttaaaatgtgctaacttttaattgtatggggaaatatataatattaagtaaaacttgtaggatacaaaatgtatcaatctatcgatctaattaaatatatgcagtcatgtgtcactttaaaatggggatgcgttctgagaaattctgtgtgagtttcaacactttgtaaatacaagagtctgcaaagacaaacgtaaattgtatagcctattacacacctaggctatatggtagagcttattgctcctagtgtagaaatctgtatagcatgttactgtactgaatactttaggcaactgtgtaaaaaactggtaagtatttgcatatcaaaaaatagaatggatacagtgaaaatacagtattaaatttgatgttaacaccattatatatgaagcccatcgttgaaagaaatgtcattatgtggtgcatgactgtttgtggaaaacatatgaaagaaaatagaccaaattatttttagaggtggaaatatttttgcattacatttcacttgtttcttcataatattctctgcttctaataacgaacgtgtattcattgtgctaccaggggaaaatagcctgaaattatttttaaaacaagacccaatagaggaaaagaaggaagagcagggggagagtaaccagaaacaaaagacatttttgttttttgtacacataaaaacattttatgtgtacttccataaaatatgcacacatgcacacgtgtgcacacacacacactgcagttgaattatatctaaagatgtttattttttcaaacttttcattttttatcccaaatgaaacatgtagagtaaccttttaaaatcaactgtggcttatagcagtgtgacattactgttttcaaagaagtaactgactttgtgaccttaccaaaaaaagtttattagctttacattggaaagcagtttactgatggagttttactgactgactggaatttacaacagccagggagaaatatccactcaaatatctactgccattctttaatgcagttacctaaatatcagacgtgtctacctgctgctcagtctactagtgtaaatatttaaataaaactcagtgtgaccttttcacttagttctgaattttcttcctctctcttcctcttcctcctcttgtccctctccttttccttgtctcattttacgcatacacactgatttaccatcacacatcaacatttgatttcatcaccataaaagaagaaaatatgttctaggaagataatagaaaatgtaaggtatgggggcattagcatacaaagggagaaaggaaggaaggaaggaaggagggagtgtgggaggggaaagaaagggagaggaaagaaagaaagaaggaaaggaaggaaggaaggaaggaagaatttagtgtgacagtcaattgtttatctcttatttccattatgctatttattctgaaaccctattatatttttatagtgattaattttgcctgaccataaaaagcaattcttgaatagacaacatagatgaaacaaactatgtaaactttatccagggatgaccttaataaatatgttagattctaacaatcttttacttttatttatagttttgttgctatggagatcttatttcagaactaaaagctacatatataattctgaatgttatcattttaattaaaagataacaagtaaattttctatgccattaacaattgcatattgttctctttacaacaatgtcttttggagtcaatgaaaattaaaaatggtcttgctatgtggtcttaataataattataacagtcataaaagattaacaggtaacagttatgttcactatatgccagaaagtgtattaaattctttgcctgtactaactcattgaatcctcatgcaaccttacaaagcaggtactattatcttccctattgtatatatgagaaaatggagaccaagcattctcaacttgtcctggaacccaagctaaaagtggagccagcatcagaacccagaaggcttctgtaaaagcccacgtgacactgactttataacaaacctaccaaaatttagcagaattcattgcacagtcataaaacactcattttccccctttttaaaaaagcacttttttccatgtttaataacttgtacgtactttgaacataaagtatttttttactattacattttattttatttatttatttatttttcttttttttcatttattattattatactttaagttttagggtacatgtgcacaatgtgctggttagttacatatgtatacatgtgacatgctggtgcgctgcacccactaactcgtcatctagcattaggtatatctcccaatgctatccctcccccctacccccaacccacaacagtccccagaacataaagtatttttaagtgtcgttacttactggtatcccaggttaactcgaatggatagagctttgatggaatgtcagcctctaggtgctgtaaatgaaagatcttctgcttcacagagttggccatagcatcattgcattgtttctttttcacttctgtgtacgcaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgaggtacatgtgatgacgtagaaattgtaataaaatgtcaagcaattgtgtcactctcctactgtattgtattattgttaattatattactacttacaccttttttattttcttctctaaacaagacactgacaattttaaaaacctgattaattcgtttcattttatttctaaatttataatcatgagtacttgaactattataaaaatcttagtaccaatgtaataatttgaagagaggaaccatgctatccaggccatttaataaattcagaataaatttaatttgtaatcctttcattggtagttaatcatgttatcaattcttcttgagaatgtgcagtacattatatgcagagggttgtctaatatttattataaagtattgaataagaaatcttagtttctggtttatattaagtcatttagaaactcatgactgtagatgggtcttttgacaagctctgttttctcagaatcaatatcacaaaagcaataaagtaaaatacagactattttaaaaagattgttcatgaacaaaaagacatatattaccttctcaataattagagattaaaaataatcaatgatcacgtttatataaataaaaatatattctcataggttaaaagtaggtatatcatatttttaaattatttggagagcaattcaaccttaaaatatccattaaaactgttaatcatatacgtaggtgagctctttaagatgtttgtcagccgggcgtggtggcgcatgcctgtaatctcagcactttgggaggctgacgcgggcggatcacagggtcaggagttcaagaccagccggacaaacatggtgaaactccgtctctgctaaaaatacaaaaattagctggttgtggtggcacgtgcctgtaatcccagctactcaggaggctgaggcaggagaatcgcttgaacccaggaggtggaggtggcagtgagctgagattgtgcccctgcactccagcctgggcaacagagcaaaactgcctcaaaaaaaacaacaacgaaaaaaagatgtttgtcacagtattatacatcctaggagaaaaggataacactatacatacaaaagcagcagaacggtaagataaaagggacacaatgctattacttagccagaagtttccgaactttcttagttcatggagcccttagtgtcttcgaactttttccacagcagtcctgagccgttaggtccaaacaacctaaaaatttacgtcctaagactttggtagccatttagagaaataaacacaaaataaaagtgaaagtagatttttatttcattcttaaacaacagcaattattactaatgggatgagtgctattgcactgtacgactggcagaaatggggatcagatttgccaatggcattctaattttctgttccacttttactctacatgatactctgtcttaatcagagtaatgagagtaatgaccaaatccaaaattcacaaagacagcacatcattaaaaggaatgacacattatctaatactggaacagtaaactaccttaagctagagtttcacacaatgtccaaaaggtgtcaaatattgttgtgttttctttaaaaatttcaaacatgctatggcacccctattagttttctgcaccaccttcatgttccttggcacccagttctgaaattggagatgtattcatatatatatgtgtgtgttatgtatatttatgtataattttataagaatatggaatatgctcatcataaaataaatggaaaaaacaggattaatagctgtgttttctattatctttatgtttaaatagtttctagttttttgcaatatgaatatacgatatatattcttaaataaaaaatttagagtagaatatgctatataaacactgatggagactttattaacattaaatgaatttaagattattggaaagtattttatccctccccctaaaaaaaactcttaaaagcaaactgattgttaaaagaaaatgtatgtgaacatcccagaaatttctatcttctctaaattagtatgtgtcttggctcatgtgacttatctcccaatgtatgagagatcttaaagatgaattattcatcctctgttaataaactttgaagtaccatagaagaggtgaaaattctggaacattaagaatgaagaaatataattctaattttcaaaaaaccaaattaaaaatttggggtcataaaccctgttgagtgtgtgacgaagtctatgactattcacgcacacacaacacttgctatatcggatcagcagtttcatggacactttgaagcccatctatatacaatgtcgtgtttgagaactgcaggtatagactaaaatacctggaacttatttattagacagaaacagtaggaagaaatttaaattaactgacaaagaatcagggtagacttaccatttctggctactgccagattatggtcctcttagagactgcaattattggcatgaaatgtaataaaagtggctgtgcttacctttatattgctacacttttctcttaatggaaagggactccctttgcttatttgtttagaaaaaacctcagggactgggccaggcatggtggctcacgcctgtaatcctagcactttgggaggccaaggcgggtggttcacctgtgctcaggagtttaagaccagcctggccaatgtggtgaaacccccgtctccactaaaaatacaaaaattagccaggcatggtggcaggcatctgtaatcccagctacttgggaggctgaggcaggagaatcacttgaactcaggaggcagaggtttcagtgagccaaaatcatgccattgcactccagcttgggcaaaaagagtgaaattccatctcaaaaacaaaacaaaaaacaaacaaacacctcacggactgtattagagtcagtctctagttttgttgtacttatctccttgatatatccacacactaactatactcaaacctcacagactgcatgaaaattagcttcaaacctaaaataatacaaattatacaacattcattcctgaactatttaaaggctttggcctaaaggaagagaaagctcgtcttgttatcttcacaaaacctgaagatgcaatgtcctgcttccccaagattatactgcctcaatcaattcttccagagtacactaaggacaaaggcattgaggcccaaaggtggaggtatgctggtaaatgcttaacaaccagctctctccagggaggaatggtcaggaatgccctgatatatagcatttgttaattttcatggtgcgaatttcccaccatggttgatttcatgctaccatatatggaactgagcagggagttgcaaagaggtgcctaatagcactatatgacggtatttccatcatatagttgcaataaatataaatgacctcaagaacatatacgaaagtaaagtgtagagataaattctgaataggtatgaattttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcactaggctggagtgcagtggcgcgattttggctcactgcaacctccgcctcccgggttcaagtgattctcctggctcagcctcctgagtagctgggactacaggcacctgccactatgcccggctatttttttgtatttttagtagagatggggtttcactgtgttagccaggatggtctcgatctcctgacctcatgatccacccacctcggcctcccaaagtgctgggattacaggtgtaagccaccccacccagccctaatttttgtatttttagtatagatggggtttcaccatgtcgaccaggatggtctcgatctcttggcctcgtgatctgcccgcctcagcctcccaaaatgctgggattacagacataagtcaccgctcccggcatatatggacattttttgtgacctagtcctaagagtttgtctcatcccctcctcttgtagctgcctacactgcaaagtgggccaatcaccacctgcaatgaggctgctagctacagggtggcttgagactgtgtggtgatatatacgtgcacttcacttcatttttcctcagcgtagtcaataaaaaccaaaggggagagcagcaaaatggtgtttggcttagattctctctgttcttcagaggacacccactgtggatattatgctgttgtcttttgcaatacagctctgctagggaagtagaggaatgactctcttgaccattgcagaaccacagactgcctaggaagaaaatcagtcacaggaggagaagcccgagtttgaacctgtttctgccctttaatggttgtgtgacagtggacaattcatattcccctttgatgaaatgaatctaatcgcattctttccatagggtttatgaggaggcaacaggaagtaatagaaaaaaatgtgtgtgagttaagattacataggctacatttaatggatgcacgtttattctcctttatgtaaaagaagactggaggcaaatggctgctccacgatcttcaagatcacagtcctttttaatcttgctcttcctctatccctgttgcaaatcactcaaagacggctgctaacatttcactttgcacttcagctagcaagaaggaagagagagtaaacaagactgtgtcctccccctcttaatgacagttcttagaatcgcatacagcccttccacttaaatatcatgagaccaaaactggcttcaaagaagttgataatttattatattgactggggagcaatgtgcccagctgaaaagcattattttttttccctaatgagggtaggaagaaaggatatgtagaggtatccaatagtccctgcgacattttgtgtacacttgaaagctaacaaaatcgttactgcagttatttctttagaggcaaggttattggatggcaaggtcattaataaatgtatcatatgagccacaggaataattgaatattaatcggacaactgcaacaatatttgttactatcagcttcgttaaagtgtcagaaaatattctgtggtccaaccagtttattttaccaatgagaattttattttattattattaatatttgagacggactctttctctgtatgcccaggctggagtgcaatggcaagatctcagctcaccgcaatctccgcctcctgggttcaagttattctcctgtttcagcctcccaaatagctgggattacaggcatgcaccaccacgcccagctaattttgtatttttagtagagatggggtttctccatgttgatcaggctggtctcgaactcctgatctcaggtgatccacccgccttggcctcccaaagtgctgggattacaggtgtgagccaccatgcctggcccaccaatgagaatttataactagaaagaataaatgacaacctaatatcctataattagttaccttaggaattggggtcagaattcactaaattgttcggatctgttaacttgagcctgcattgcttttccagagcaccttgatgaggtggacttgtgcctagagttgctgaaaacagggaaactgtaaggataatttgaatcccctgcagaaagtgaaaggtccgaattaaagaaatatgcacacagaggaatatgtatttaataatattaaacattgacggtattattactgtcagttggggaaaaattgttcaaaaagattgtaaacaggagacgtagtactccattttagtatcaaaaatgattgcctttggtactaggcacacttaggtagtacctaatatgttcatttcagtgcaacttgaaaacattttcccaataattctactttagattactatttcttctttgtagttttctgattctttgggatatatttttcctcaattttccttttaccttcttatatatgaactgtgtggcaaataatacatattcagctaaccattattaataataattgattttattgtaaatgaggcctttgtttttttttttaccatcacctcataaaccacaatttgtgtttccccccctaaaagtacttaagcatttaagatgccataacactaaatcatagaacataatttgttcatggaccttccagaacacagaatatttgacttatgcttcaaatatgaagtcgtgatttttaaaaatgtcttcactgttgctttcatttcaccccatcaaacatgctctggaaaagcaccacaggctcaagttaacagattcctaaccatttagtgagttctaaccccaatccctaatgtaactaatgataggatattaggctgtcattgattctttatagttatatattctcattgaaaataaagtggttggaccacagagcattttctgacattttaatgaagctgatagtaaaaaaaatagataatggtaatattgtatgataatttaaaagatatatattacaagtattgtatatcttgatattataattagcggttggcttcatttactactaattcactattcatagtaaatatcatccttgaccatgcaaatactaaatgcaattttgtatcatataaatttaatgctatagtgtatattgatcaaaaatgtataagaaatggatattttctttctataagcgatagcagccagagaaacacagtaagtagcattgtcttatttcttaagatttaaaagacctataatatctttaagcctacacagctcaactttgagttcccaaatcctaagtggtccctaatcaatattgtaatgatattttttgaactattttctacatccaaaataaatctaatgaatttttgacaataatggtcattagactacaagtctgcatagggtaaatacgatatcccttgctttgggctgcagttttatcagcttattaaattagtgctgattatctcatgcttactggaggcatttattgatagtatgtctttgaatgataaacataaaaatatatttctaatattatttgatacaagaagtttgctgaataaaaatcttttaaaatattctcaagaaaatttataaaatgcctttggggcagtaaaattgcaaaggatcattgcttttttttgttcaagttataatctaattatcagaatgaatgactccattagacacttcaacaacaacataatttaatatgccatagattttggaggcagaatgctataatatttgtatattttggttgaggtatagatacttgaccttcactgtattcatagttttgtctagttcatcataatacaatgtggacgtttacatttaatttctttttctcaaagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtggtaaggattttcacccgcaaaatattggtctataaaatatcaagtaacatttttgttttttggattattgaacaacaacaaaatcatgacatttttcatcatatttgtgtttgggcaaaatgatgtaaaacaaacattagagttatcagaattagtatagatacttgctattctttgagaatagctaatgggactagcttgaagtaggtggttggttttattcccacggagcacagaatgttagactcaatatttctggatgactcgtggcacgtgcttcatcccagcagttagcagcccttaaaccggcagcatcgtgttttcaaatatctcatcacatgtgctctaagttacttgcttatggtttaatttaatatttttaaagtttttaaatcagggactttattatatttactcctgtgcttccaaagatgatttgtttgaatatgtaaataaatacactttttagcaaatctctaaccagactaaatattacacagttaaataaagcttgatttccactgcatagccaaagctgtgccacagaagttcacagtgatttttttctgccttttgtgtgagttggtgccaggtttcattagattttggaaggagagcaaaagtcaaagaaagccccagcacacatgcttccaaacgacactactccacatccctaaaagacacttagtttgcaattttagtatgagagttccctatggctctgcaagaccaggagctgctttagcccagagaggctatttgggagagcttagaattccagagacccatacaataagaagatattatgcactataagtacaataatgtcatgagtgtttgcactgtgctccaaaagagctctgatggtctcgttgcctcaaatttgagcccagggtttcataaaatgatttgacaaatggaaatccctgaatgaataaacagttcaggttgaatatggaaggtttaaaacaataacttcatgcaaatgattatttaataaataattttcttaaagtaatcataaatttatactagaaattaaaacttgaactttggttaaattttctcataaagtatattgactatggaaaaataataatagctccatttataggcaacaggtattgtgctaggcaagtcgtattttatatttaggatgatctgagaacaatactgcaagaaggatacaaacattttgtagatgaaaacattgcgatttaacatggaaaaaataagttattttatgagaaaaataacttttattttatgagtaggagataaaaagatagatgtatagcctggtatagtgggttgctgctgtaatcccaacactgtgggaggccaaggcaggaggatcacttgagtccaggagtttgagaccagcctgggcaacatagtgagaccatgtctctacaacaagttaagaaaattaaaattaaaaaaataaatcaaattgaattaaaaaattagctgggcataatggtgcatgcatgtagtcctagctgcttgagaggctgaggtaggaggatcacttgagcccacaagtttgaggctgcagtgagccatgattgaactactgcattccagcctgggcaacagactgagactctgtccccccaaaaataaaagaataaaaaaagattatggattcacaatatgtgagtttgattatgctctataattacattttattttaacaaataattgcagtgagaaaacatagaataaacttttgaatcaaaatatacatacatacagaaaatcttagatgggatagagacaaataggacattttgcaagcaaccctgcaaagacaagtgtttatataagaaatgtactttcaaagatgttgggtgctggtatttcagtgaaattgactgagcactcattctacctcctcttcccccacatactcattccctcattatgcattgactccaaagtcagcaccgttactctggaaggatctttaattttgctagggagacaatcccctcaaaagaggtatgtggtcagttataaaatctcaattattatgcataggcagttctttttatcagtaaaagcgagcatttaaaaataatcatctgtgatggtacagagcaaatttaatttgaatattaattcagagagactgcctgccttagatttaatggttattgtgctaaaatggaagaaatcagcatcaggtatatatatatatacacatatatatatgtgtatatatatgtgtgtatatatatgtatatatgtgtatatatacacacacatatatataccatatacatatatataccatatacatatacatgtaccatatacatatatatgtaccatatacatatacatataccatacacatgtataccatatacatatacatataccatacacatgtataccatatacatataccatatacatatatatggtgttgttaaaaatatatagagaaaaagagagacagacatagagatagaaccaatgaaaatatcatccaattacattccttaaaatattatgataggataaaagaagttagaagcaaatacagatttttagacctgtaaagagaatgtagttaggcactgaaatatacaatttagtgtatctgaatgataaatatttttttcttttttttcttttgcttataccaaggaggaggagtatagaaggggaggggaaagcctgaattattgcaaattttatctccatttagcccatttatagtgctagttatacaggaattaatgcattgtgatataagcacaattcatgggaatttaaatgggattttgagttggatactaaaataatctccaacaaccacaattacattaatgctgaaaacttaatatctatctatctatatatgcatatacaaggtatatagataaaaatccaaatatatttccctaaaatatcagtttcataaattgcaaacatatgaccatagtccccactgagaccagagtaatatgttaattaatgttggcattgaccacccagaataggacagagcatctctctccctgacttatgttcggccagcagtagctttgctgtcttcagaaagtctagtgatccacagtcacacccacaacacacatacacactttacaactcatggtcagcctatcacatcaggctgtctggctgtcaatcccatggtggaagctgcttgttatagttagacagccaactgctgctcagtagtaggtcttacactccaagtagatccgtagtggtgcatccagtcactgaatccatgctctgctgctgtgtgtgagtttagcttaggctcaggctgtgcttcaaaacttgtagaactatactttcatcagtggtctgacatggatgttcattttattctgtgttttcctcagagcctgtctttctattttacagggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggtcagtgaaacctatttgacatttgttcctgaaacttattgcaatttccagagttaatgttgtgctttgtttggttttgctggtgttacacgctcaggattaggttttaattcagatcttcaagacgcttacttggttgtagtgtgtgctgattgaataaagaaaacttggaaagttgttgagagagcaaggcatgggtgaaggagaaaattggttgagattggaaaagcaaaatctattccttaccaatgctagtttatttttaatagataaattgctcttcttttaagtgaataatttatgtttaaaaacaaggaatgtttattttaaaaacacaattgtatctggtatcttttctctttatcaacattcgtgtaccttttactattagtaacaagattatactaattttaactttaaggaatattccactgctggaatcagaacttcaaaatgatcttgctaaaattatgcaaatggttggaaaagaaaacgaaagtgaatataaaggtggaatgacaagatttgtgtatcaactgacggaagactggcttaggcaaaaataggataattttaaatttggctttgtagtgatatgacaaatagaggcttaggtaatattcttgttatttgaatagacttcgcaaccttggaagttctttgataaatacagtacaaagaaaggtgacattgtaaattgtgatgttataagcaaagaaaaattagtctcaatattggactgataaatagtaactgttttcatctatttttcttgagatagtctttgcaatagtcatacatatatattgtgaagaactacttagaaatgggagatacaaagaaaactaacatttactgaacacttagtacagatgtagcagatactgaaaggagtcatgacagagagctcaattgggtgaccatggactctgatttctgaatatgccatatactctcatggcaccctatgcatatacctgacacggtttctaacacactatgatttttgtccctctcttttcccctctaggctccatgctccttgacagcagggaccatgctcctttttcttctgtctctggcatatagaatagtacctgtaagaggtgctctccaatatttgttgaattcaatactctgacccctttcaactaacagaatatcccctgctatagaacatatatattttcttgtaaaataggctttatgtttgtgtgtggcctgaatgtatggtctattactgaaaaggattcaaggaagccacaagaaatgttatgtcagagatgtgcctaaattattgaaatcaaaggtattgggaaatacctagttattcactttctccatttctgctttattagttttgctttttccttgaatgtctagtcaaaatgattaatcaaccatattttatcactacattcgtttataagtatacctagggaggtttacagcaaatcgaaaatatctggagagaccagaaaaacagataaaacaaaaacaaaagcaaatgtttgccacagttgaaaaactcccacattatattgttatgattaatgattattgcctaatgactaaacataaaaatattagtatgaaggcctgtctccttgcagtctctgagcaaatccgatttgctggtgggtttccatgtaacaggagccaatatatttgaaaggataagatattaaccctagtggtcaataaacatgtattaatttgatttggtgtaatttagtactccaagatactctcacctaatttaagctgtgtttattttgaaaattaaagatagaatgaacaaagaaatccaatacatgacagttaattcaccttaatagatttgcttaaacctaataaaaatggactgaagagtttttgtcaatttagccaagaatctgtgcaaattaattgaaaagatataaaatctaaagatttccgtagtattacccttctataatccagtgaaaataccttactgcttcaagcattttatataaatatatatatatacagacatacatacacacatacatacatagtggaaactaagtgctcatatttgagaaacattagttgaaaaaaaaattcaaccatttaaaaaagttatattttatattcattcattcaatctaaaagtacatatggaaaccataggacataatttcctctgtcttttaatgtattttatcaaattcaattaaatgtgtaaataagttagtaaagtggcaacactgagaaaacagttaagtcaggattctaatgtttgctttaacaaagggaaatatatctgtatcacagctattctactcttatcagcatgagcattgaagaatgtcagtccacttctccttttgtcaaatattttgattgaaagaatttagaaaatgcagaaaatctagaaaagaaaaataaccagtgataaaattttggtgtacacacacaaagtagtgcactgagaaggtaatatagagactctcagatactgttaatatatactggtaacttagtttttatttaataaattccatggtccaggatgaatgtaacccaattagatcaaaaacctttttttccatcttggtcaacactgttctttgggaattaatttaaaatattaaatacatcttacaagtaaaataatgtttaatatattgttcaccctatctttgtatctttctttccaagttgtgattactgtcttcaagagtctcattagtaatcaacagtagacttgacttatgaaattcagtcaaactcagtagccttgaatttacagagtggattatcttaccatgaaaatattgaacaagttgcaacatcaacgttttctgatggatagccaaaaacaaacaaacaaacaacaacaacaaaaaaccctacttactttttgaaataagtttttatttcaaagtgactcaattttatcccagtacatcattttttaggacagaagttactgatttatgaatacatatttaggcattacttttaactaggcataaatgataatattaaacaggtgcaaaaagggtctaatgaataatagctgttcattctgggcataattttcattttaactttaaaattcaaaactctggggaaggtggacctagaaccatgtttttcaaataattttgatcaaagtacagtaagaaaatattttatgtcatacccaaaacctactgacacaaagtttgatgaaataaaacttgccttgctattttagatgcactatgataagtgtgatattttcttttcttttgctttattcttaaaaaaaaaaaaagccataacccactataataatttcatgtcctaaatacagtttggaaaacaccgacctgacctgcattctttttcttatttgaagtgttggaatttttaaaagttttagttgcctggaagtattaactccatcactctatattggaaaactaaatttgtcttatgggaacagtattataatattataatggtagtaaaaaagcattaatgtacattactatttgaattatagcaaaaaaaaaaacctaccttttgaagtaagtttttatttcaaaatgcctcaattttatgccactaaatacaaacatatttagaacaatactcagttgtcgtctgccaatattaacaaggtaatacaatgtgattcagcatttattatagtggggagaaagtgatttatcttaatattctctctcagttattggaaaaaaattaacttctctccatgtataaacaaagcctttccaaaaagtcattcagaatatgtcctgtcctaaatcagctgttttcttatactcaagtattggaacatccttgttttgttaatgtaggtattgcttcaattttcgaatggctgttcagtgtccacactgtctcagaaatatgtaatcagaaaagattttctcatttgtattttcatctccaaaggaaatcttctgtggacttgttttatttactttgcttcttagtaaaatttcctttgtaaatcattgtgttccattgggtgtctcaagggaggagtgggagttttcttggttcagtgtgtggctgggagcatgctgggaaatagttctcagttcaatctgggcaaatgtgtttgggaacactccaggcagtgtctattctaagcaattaaaatatctctgttcttgattttatgaacacttggaaatgtagccagcatattaatatttctttaaaaaattaatttataccgttttccaaagttcagtgataacttgccccatgagacatccttttcatcatatgagaaaaaaggtctcatttgaaatacaatttttgatgttttagttgtttactgaaaattttttttcagttctatactgatattatttcaaaatgtcttaaattcttgtaactcaaaaactaaatgtttcagcattactacaaatactttaagagatttgttttattatgttttacagcaaaataattggagacttatttaacaagatatgttctctaattcaagtttaaaccatatttattagaagccttaaaagatgttacttccctttgatccattaaatttaagtttttctgattctaagaaaataaagaagcacccagagttatttatcacaacatatatacaataaccaaagtaattgaaaacaaactactgaaaatggacatgtgattttaaagagtgtatttttatgtggaatactattatgtcattataaatcacatttcttatataaaatttaataacatggtaaaaaatgctaagaataaaatttttaataaaaacttaagtagactatgaatctaatgtcattattataaatataggaattttatttcattccaaatcagaatgaaataatataatactaatgttgatcatctctaattggtgggttatcagtccattatattaactttttaatatattttctctaatatctatattttctccaataaacatcaattgttctcagaagtcaaaaacaatatgctacaaaacaattgaggataaaatgatatttctgaaaagtatgatgcttaacaatgttacaaatggaaattaaatagcatatcaatttaaaaattctaatttccttacttagaaacatgtacagccaatttcttaaaagtttcaccttaaataataagcttcaacagaatttcaattgcatttacatacaaatggagcattttataatcaggtgcagaaatttggaggttgtgtctataatgtttaattatttgaaaatattcataactcattttgaacaaattccgcaccatctatgtaattttaaaactatttttcaacctgggtaaataattggatagataagtagataaatgattggaaaatagatagatacgtagatagatagatagatagatagatagatagatagatagataggtagatagataaaaagtattgtcccttaaaactattgctagctatcaggtaacaacatattcctttttctcaataaaggaatagattgaataaataaataaatcatcactttattcccaaataatctacatacaccatacttttacaaaataagtggctaaaaagtaatttttagatttttgtaccttttgatgggcttgtagatatctaaaaatttccggtaaaggcaaatccatcatcttaagatacaaaagataaaacatggctctgtattcttagggcgaaaatggagcctaagaaattctgattcatagagcactgtactcactttaattaggagcctagaactgagctggaaaggaatagattctattgtttggtggatcccaaaagtgagatagataaagatctgagtactagatctaaatagacacatagaaataagatacccttggacatatctaaaacatattttgctgattttattccctgaaattcacaaatagacttgctgtgagagccacatggtaccaagtaaaaggcatttgagtcaatggtatgttgctcctgggtagcttcacccaactgactttttattatatatcaattcctagtgtggctgtaccactatcatgcgaactgagtggaaatctacctttaattatactgcagtgaatgctggtgcacatttttcatcaatagaagcattatagtgcagaatgaaaggaaaaaaaggaccgggggagagttttatgatgttagatattgacttattctttagaaagcaaaagggacattttaatttataatcacactccaggacaccatttccattctagtttctacaatatttttgagccttttaaaatgttctatgcctttttcagggaagatgaataaaacatgttgtgtgtatgtgtgtataataattttttaaaattccaaaaaggcaataaagttttagtaactttgttggataaaatggaggcaaaaggtgccaatgagaaccagactgtgtttcaaaagcttcagtttactgtacaaataaatcgaagagaaaaaaaaatcagatatcactagttgatactaagagaataaaaatgaattatgaaagaatagcaaagaacatagcccaggaactccaaaaataatatatgcatgtagttgaagatgtttctaagacaagaacagggaggacatagaagcaaattaactttgctgaaaagccagtatatttctcagttaacagataatattgtatctacttaacatgtacagaatgatgtcctgaagtacatatacaatgtggtcctttacctttcatttaagtgtaagggctgacacttcatgtaaggttgaaacttttgtagtggataaatgagtaattggtaaatttaagcaatatggatttacatagtagagatatatctaagtcaactttagatgtttttgcaattgcgtgtctaattttgtttcaaatagttaacaaaataaatagtgttggcatgaaacaatcagggatgatgtaccttcataatcagaaaaaacacaaagcagtcattggtttggaaccttccccacaccacttcccactccccccattaacctcatgttgagaattaccagggataattaacttgaccaggaaattcagactgtgagatagtatcattgcccagcatctacctccctcaccttttaatttttaagtaatttgggaagaatgtaggctcattaggttatctgttgcttggttgtaactagatgtggaaatcagccttcttgggggagggattctgcagattctgtgagcctctgaaagtgacttgggatcagctgaaagaatgactcctttggaaactcagtatcatgtttagccacatatatttcttagtctctttcctttcttcatcaaggtttttcacaagaaaattttgggagagtcattcaacatgcatagaaagtaattacctttggtaaacatggtatcaggaaataattatggatatggccccatctgcaatcatgactacattttctgacttattttattctgatatatttcccttgaggcttttctaacctgagctcagaccctacttctgggaactgaaattctgtgctatttctgagtcctctttcttctctccagtcagtgcttttttcctttcattcattctctacgattcaattttataattacagttgtgcctagattcttactgtagcgcttggtagactctgatgttttctgaaagatactgatgacctgcctagatgtctgttctctctacaatcacttctagtctttcttctagcacttccaggctttctgagtgtctttccgagattgaatctctattgctgaacctctgtccagaggccgagatcttgctacccctagacgtacaacctgctgcctgttccctgcctggatattggagtactgctcacctccaatttcccaggattctctccttccctcattccaatcctctgctattttatttttaaccctgacatggttgacttgattattttaggtcataacttcctcttgcctatgaatattgcttacccttttgggcatgaattttaactacctcccaatctcaactgctgctatcaatccttgtgcacacctgtgccaaatctcagccacccctgtattctttgtcatcaaattcctattgcttcttggaatgcaaatctaacatatagtggattggggaaaactacaagcagaaaactagtaaagttcacatagtcccctaagatcttagctttggttgagcacagcttgtcagctaaccccatggccaagatcctaggatcgagagacctgcatctgtaatgctgtacataattttatgggcaggggccagaaaagttgtcctgttaggaaaggagagcctctggagctcattggtagttatcaggcaacttctcttttgtgctccctcagatctgctgagctagctccttgctgtactgctataaaggctggcgagaatgagactccggggccatccagatatgcctcttatctactgctaagattatgatgacaactgtgataatagataataactattgaatgcttacactatacctgtcactgtgctaaagcctttgcattaattatcttgctatggctccaataacctcgtaagttaggtcctgcattattgagaaacctttctatctcatttatacaaatggtaaagtcattcttctggtgacacgagttcaaaactttgagaaaaatcaaattttgccttttatcttttcctgacacatgcgaagatttaacaatcaccacccttcttttaaagtgcctcattcatccattatctctttaccctaattcaaaaattcataccttgaaaaactaatcaagggcatcttattgcctaaaagaatgtttatcttcaattgctgacctatttgttagggtataggcgttatgagcatggactctggagccagattgcctactggctatcatggattgagttctttctctgtttcagtcactgttgaaacaaacataatgtacacaacggttttaagccatttaatgcttggaacaactccacaagatgaaggacattatcatctgcatttcatagattaaaaaaaaacacaggaatagacatgagtaactcaccagggcccctttcagctagtgaatagaagagctttaaaaattgcccagagcatttgagtctaaagtcactaaccttggccactacctctcatattcatgaaacactttggtgttacatgatcacacaggatcaggtactgtggaatatgacacatctgaaatatttgttgaaggcagaacctgacatcaatgatgtccttatcatgtccattggggttctcacaggagcattttaagtaatctcccttatgtttctaattctgtctcccatattatccaagtttctatttctacaatacaaggaagataattcaatagtttcccattactaaagaataagtcctgagactttgctgaagttgcctatcagcttaaggagattttgggctgagatgatggggttttctagatacacaatcatgtcatctgcgaacagtgacaatttgacttcctcttttcctaattgaataccctttatttccttctcctgcctgattgccctggccagaacttccaacactgtgttgaataggagtggtgagagagggtatccctgtcttgtgccagttttcaaagggaacgcttccagtttttgcccattcagtatgttattggctgtgggtttgtcatagacagctcttattattttgagatatgtcccatcaatacctaatttattgagagtttttagcatgaagtgttgttgaattttgtcaaaggccttttctgcatctattgagataatcatgtggtttttgtcattggttctgtttatatgctggattatgtttattgattttcttatattgaaccagccttgcatcccagggatgaagcccacttgatcatggtggataagcttcttgatgtgctgctggattcagtttgccagtattttattgaggatttttgcatcaaagttcatcagggatattggtctaaaattctctttttttgttgtgtctctgccaggctttggtatcaggatgatgctggcctcataaaatgagttagggaggattccctctttttctattgattcgaatagtttcagaaggaatggcaccagctcctcctaatgggtgcagcacaccaacatggcacatgtatacatatgtaactaacctgcatgttgtgcacatgtaccctaaaacttaaagtataattaaacaaaaaaagaataagtcctgatttcttagcatgccacacaagaacatgcacaaactatgctccactggagcatttggcctcatttctcctactttgcgtcatattgactactttccactccctgacaaggatttccttctctatattccatcctagcaaactgccatttatcatttattgcccaattttagtatactttccttccccaaaccccaggaaacaatctaccatcctctagtatagtgccttgtatcttgaataacaattattttttgttacatattaaatcacatactcctctactattatgtctccctcatatctgtactcctaacgccactcatgtgtcaggaaataggtaatcaatactttcatctttgcttttttggtttgattcacacctagactgttgcagtttccttgctcttctctctgcctcctgcctctctaaacaagtccattccacacatttcctcctgattacaatttcaaaatgactgcttccattgagtcatgttcccattcaacaatctttcatgaacccccaagttttaaagatggtctcacatgtcctctacaaaaagcctgaatactaattccatggcgatctcaaatcctttacaaattttaaattattgtttacatttgtttgacatgatttattatattgttaagatatttgatactctgttcaaaaatgcttcatcttctaaatttttttaagaacaacaatcccacttttcctttgtctgtccacctctgagtttagcacaatgtcttacttatggcatgtttctagatatccagttgattgatttttttaatgtactgataccaagatgttataaactataactttacaattctgttatcttcatcagtttatataaaccaaattcattataaaagaagagtagcaaatatctcaaaggaaataattgcttcactgtgggaggctaatgtgtgtgaaattgatcaggaattaaattttaatttgatacttttataataagagattttttttaaagatattaaagcctagagatgtactgggtaaactatttcaggagtaaaatgaaagcgtgtatacatttgccagaaaatgtattctcaggagcatgacgtgaagtaaagccttgaaattagtcatattccctttgtatttatttttttcacacagaatacaaaatataaatgtgcatgattaaaactaatttagttttattcttttcttcaggcttgggaatgcatttgacacgattaactccagggaaaaacaagagaataaattttttttgtaccttctacttgagatctcagatctctagtcagttctacacgattaaaacagagactgtccctttattgtgggagtctagtctgacttgctttgttaagtgaaatggcatctattgatgatcaaatcatgttgtctctgaagtattttatttgaaaactccaagcaataagattactgtttagaaaaccaaacagaaaaacataaactttagagtaactttatacgagacattacgtgtggacacggagaagtaaatttcacccccaccatacttccatcctgaccccagcacctttatcttgggttcacgtaagaccatacagcatacacatactacacttccagcacactttgttcagctatggttgacagaatagagctaacacattctccacttttaccacgtattctttataatgcaatattctatagggaaatgtgaaatctggatcacatgtagatctattggcaggtacgtttctaatctttttctctccaaaatctactgtatcctatttcatgcaggataatcagtgtcatcggcatacatagcaaatggtttgttcataaaaaagcttgatgagggaaataaacccttgatagtctctataggaattatttccattaggaaactgaaagaaaaagagggtgttctatatgtattgttttactgcccatagcagttttgtaatacacaataagtttattacatagaatagccaataggcatcaatattgaaaaatagagaatgtgagctgtattcctgtacatgcgtgcattctcagcaatgttgtgtggctgatcggtattgtgtgagtgcgtgggtgtgtgcaggagtacatgcatgctttttaaaaaatcctctaatctttgatgaagtaaaaaacgttaaaattcaataattctaattgagtgctataatgtctccatttgccacgtttgaatgatttagaatagaaaagattaaatcagtaagatgatatgacattagacaagtcagaattatagctcatctaaaacttgtattaagtgtttgatttctttcattcctcttctcaaacatttgcatattaactgttaagcaacaaaatacagcaattcctaccatttctaatttccttttgttctcttaataaaaccatgacaaataatgcaggcaagtaaggagaagaaatattcagtgaagaatcctcaaaatcggtggttctcagctaggagtgattttgacccccaggggatatttggcaatacctggagacattgttggttgtcacagctggagagtggggggtaggatgctactggcacacaatgaatagaggccaaaaatcctactgaatatcctgcaaagcacaggacaatacctacccacctgcacctcccaccaaacaaaggtttatttgtcaccaaatgtcaatagcatgcaggttgaccaccctgacctgaaggagctcctctgttgcactctggaagttgagtgccccagagggagaagcctagacctcccacccaccccactccacggacttccattttctcccatactgaataacaagttaacacgtttagacaagctgattcctgtagtcccttttaggtttgtttagagcttttctcctgttttatcattttgctctatgttgttatggtttcctgttttcctttcccaacatacatatttagaaaaattccagactcctttctttgatttcacttttgctttctttgtggaaattttgtatttcaaagcaatgaagagacgttgtcaattcctcttgggtatggtcagaataaagtataagataagagagttctcccggtacacactttatgtactattctaaggcatattttgttatttgttttctacagatgtcaagctctatttttctaaatatttgactctctagtacactgcatcactatgacttgttcctaccatttttatcattagtagatgcaaacataaattatgcaactttgtgtgagcttgacatgaggcagcagataattatcgcactggtcaacataacagattgccaatattaggttcaggtgttatgaaaatttaattatattacagcatgagaaaaaaattgagcggggaaaggagccttaactagcctgtgttagcctgcaaagtgtgttctaggggctcattctgcactttcttgttcttccgtctctctcctctgctcaccttctcagtctgccatgccctgctctgaagaggcacccatcatttgccccagcaagccacctagcctgtggagcagagtgacaaacagctccactttgcttagctctgggaggaggccatggtcctgacccaggggtccgtggggaccacaggctatgacctggacagtccctacaactataaaatgccaccaatggaggaagctcttgtgaaaacagacattcagatagctcttctgggtgttataaacgagtaactccttgttctggcttggatgcaaaacagattataaatgtatggctagtatcatacttgaagattatagaggaaatgttgctgttctactgtttaatttaggcaaggaaagtttgaagtaaaaaagaaaaagtgatccagttgcacagctcatttgtgaacagattttttatctaaatatagaagaagtttaaattttgaataacactgaagtgggttcaggaggtttggctttcatcggaaacaattaaaatgtatgccaagaatagaagatgagaaatcgtacctttttcttaaaaataaagagtttttgcttaaagtgctttagtgttttgcaattctgtcaacttattagctttactttctaaaaaataaattttcttatgatcaaggaaagagtacttctgctgggatcacatagaagcttaatttcttgttttcccacaattgatgattgtatgtgtattagtccattttcacactgctgtgaagaaatatcagagactgggtaattcataaagaaaagaggtttaattgactcacagttctacatgactggggaggcctcgggaaacttacaatcatggcagaagcgaaggggaagcaaacttggaacttttcacatggcagcagaagaaagagagtgagtagcgaaggggaaagacccccttataaaaccatcatatctcatgagaattcactcactatcaccagaacagcatgagggaaactgccccatgatccaataacctcccaccaggtctctccctagacacttgggaattatagggattacaattcaagatgagatttgggtggagatacaaccaaaccatatcagtatataaatctgctttgtggtgacctaatgcaaacagtttctttttaaaatcaaatgtacatcaactacttacacaaaaaacctctattatttaattcaataaatgattccttttcagcaaaaaaaacaaaaacaaagtgtgtcccttagagctctaagtgggagagagctgaaggcatgatagagcaaggagagtgagcactgaacacctttgtccttccacggctcagcatcctctgcgtggactgtggtcaggatgattttgcatcttctttcagtagtcagcttagaagttcctcctcctcatcatgtgttcctcctttctattaccagctcccaagtgggcctcttgttttgctactgataacacctgacatgctactgcctttctatagtagccgaacagaggagaacaatctttcttcctctacctttactaacttgctctttgatcgctacaaaaaaaagtacccagtatcctgtgagagtaataaatgagatgaaaaaattatataatgagagaaaaaaagtaacagtcctccatgactatcatctcatctctgtgattttattcatacgtgaatattgcaaacacacacacaccccacagagtctttcattttgggtacataatatattaagcactgagggtataaacagagtgccctcactgtatagataaatacataaaacattatagattagaaaaaagctataaagaaatcatgcaacattatatggtaaaaagtggtgggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaaatagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagtggtgggtattcaatttagactcagacagaaaagataagaaaaagtcacgcttggataggaaaaacctaaaatacagaagtcctatgacttgtaaatgtgtccagaattggttccttccagtgggtttttggtctcgctgacttcgagaatgaagctgcggaccctcacagtgattgttacagttcttaaagatggcgtgtccagagtttgttccttctgatgttcagatgtgtccgaagtttcttccttcctgtgggttcgtggtctcactgacttcaggagtgaagccacagaccttcacagtgagtgttacagctgttaaaggtggcacatctggagttgtttattcctcctggagggttcatggtctcactgacttcgggagtgaagccgcaaacctttgcagtgagtgttacagctcttaaagctggtgcatccagagttgtttgttcctccaggtgggttcatggtctcactgacttcaggaatgaagccgcagacccttgtggtgggtgttacagctcataaaggtagcacagacacaaagagtgagcagcagcaagatttattgtgaagagcgaaagaacacatcttccacagcatggaaggggacgagcaagttgccgctgctggctggggtggctgctggctggggtggctagctcttattccgttatttgaccccgcacacatcctgctgattagtccattttacagagagctgattggtccattttatagagtgctgattggcccattttatggagtgctgattggtgcatttacaagcctttagctagacacagagtgctgattggtgcatttttacagagttctgattgatgcatttacaatcctttagctagacacagagtgctgattggtgtgtttttacagagcgctgattggtgtgtttacaatcctctagctagacacagaatgctgactggtgcatttacaatcttctagctagacagaaaagttccccaagtccccactcgacccaggaagtccagctggcttcacctctcataaacatatcactattcaatgaatacaaaaaagggcaaaaagaaagaaattagtttggagaggtaggtagaggccagattatggaaggtataataaactatggtaagaaattagaatgcaagcccactggaggatttcttttaagggaattgaatgatatgatttttaaaagatagctctatctactatgtggatagtggatagatagatggatggatagataggtagatagatctctatctactgtgtggatagtggataggtacatggatggatggatagatagatacatagatagaacagaaggttatacagattatggagtgggaggtgagaacagggaaaatgagataaggtggaaagcattgcataatccaggagtaagtaatcgtagttttatctatgatgatagccatgtatatgaagagaagttggaggatgtgagaaatagttaaaagatataactatcacaacttggcaataggtctatgcagagtgtgaaagaaaggtaggaatcaagactgaattgtaggttcctcactttatttataggtaacagtccctttagctgatatggaaaagaatgcaaagagtttggagagaatccagtcctgttgtggacgtgtcacgttttagatgtctgctacctatttaggaggacaaggcaagttgtcagttagggatgtgagtctggagctcagagaagagtcaaggcttatgttatcagcatgaggatggcattggtattggaagccatagattatttactaagtaagaacagataaacagagaagaggaaagaattccaagccaagcctccaggagcttcatctttcaaaatttggtaagaggaggaaaagccagcaaaaagacagagaatgggcaatcagataagaagaactcaaagagtactgaaaggaacaggagcacgtcttaagaacagtattgtaattttgttaaaagaaaaaatgtagagtagagtatagttcagaagtacaaagaagataatagaaaaaaaagtaataaacctaagcaggcaactacataataggaaattcacaacttagatcttgactaagtgcaaggcagaattgtaagtagtctaagaattattttccaacatctactgcttactaattttatggaaggcttagacaggaaagatactaatttcactagatagagaaaacctaggctaatgctctttgaaaactgaaaaatattgttatatacgtatgaattatgaatgttgatttattgtctactccttgttcaaccccttcctccccactccttatgagaaatctgctcaaaatggtgaaagtacaaaaaacagaacaagacgacaacagagtaggtaagtaatcacactgtataataaagaaaataaactggaactacttggaatgactattgaggggagatggaaggatcagacaaaaccccaaaagaaacccaaaggactataaagaaatagaatatcagccaagggatgtttttaatgaaaaccaagaaacagaaagctcagaactaacatcggctaaggggcagtctgtggcaactaagaggtgcttgatgtattttaattcacaaaattgtcccaacacattgtgaaatgcatatgatcaaccttttgtaaagagaaggccaaagcttaaaaggtcacacaaattctcatagttttatctgtgatgatagccatggatatgtgagagtatccaagttttacagaggccgagttggtacttgaaatgaatttggctttatttttaaactcctatactttctagtaccctaggctagtgaaaaacaatgaagtggcaaatgttccaaagccagggaaaatgttaagtaaacccaacgctaagagggaactggtgtaacgggaatgataaacatgagtataattactcttttgtaatgttaggctgtgaaaaaagtgagaaataggccgacaaaatgatagtaaagtcacatatatctagcatgcaaactattgaataaaacaaatagccaaatataactaaatataaactataatttttttcagctaatccctagaaataacttaaagatgacaatgcaaatattcacatcttgtttgggcaattcaggcaaaagtctaatttaatggccttaagtttagtgtttccattcttcactttcacctgtgtaaacataattgttttgtttctttgccaataattttatggaaagctttttctaaagggtaaaaacaaaactaaaaaaaaaatcatgtacacataaaacataatttttatttaacatgtatttggcagtctgttttgtttgcaaatccaaaaaaggatagttccttttagggatttttttaatgtgttactccaacatgttttcactgctcctgagcagttacaaacacagcacagagctgggaagagcagctgggtctatctttggctttcatgcactaatgtggaaatggaactgtctttgggaagccttccttgttaattgctaagattggatgtacttttgcatccaaattcattttccctgatctagttatggaaaaaaatgtgctatcttgtactttaccaatggaaaatggtggaaagcatcatgtcttctgcccccaaatgtgtattttgaatttgataattacagcaatgctgacatagccaatacccagcctaagcagtttatagcaaagacaatgactcatgtacataggggattaaatctgcttctggaaactacataattatctagtcgtattcaaaaatgttatagtcagaaaagcacctaatgattcattggttctgttctctgccttctgcttgcttaaataactaaaatatattgagtaataaattaggagcagtaggttgtggtggttaattacatagactctagaacctgaatgcctgggttcaaatctaccacatacttaaatgcctatgaattatacttaatctgtgtgtgccacaggcttttcctttgtaaaatggtataatggggataaaaatagtatctgaattcctaggctagctataagaattaagtgtgaaatgattaggagggtaagtggctcttacaagtattagacttcttgttgttattatgttattggtactgatcttggtagtacgaaaacaaaaaggacaataatcaatacctcaagtaatgtgtttacagtatagttgaggagataactgcataaaggaacatttagcttatcatatgtgtttaaaaacattattagatttgatggtaaaataaccagtttagaatgccttcttattagacaaatatatactgtaaacattgtgtttaaattatgcttaaagtcataaaaaattagaattaaaagaaatcttacagatcagagtattcactgtattatttaaaatggggaaattgaggctcagatgttcagagaacagcccaggattacacggctatgcactgacatgacccaaagcatagtaagtctgatgttcattcctgagctttttccattggttcatgctggctttacaaactgagaacaaggaggtcagtgtggatcagagtagagctctggagtacttttacaattcagctgggtgagggaggaaaggcatttaggaagaaaatcataaagataggtatgctaccgtctcctctgttaaaaaaaaaattaggacatcatttgagggaagcagagacttttcatggagaatgagtggttacataagtttctacactcatgtaacaaatatttactaaacattttctctatagtaagcctactgtgttctgggcatataatataaattggggaacaaaaagctttctgaactatagagagcttaaactgttgtagaagtagcaaacatagcttataattgttatatataaataaagtatatagaaatgatatagaatgttagaagatgacaagtgaaaataccgtgaaaaagaaaggaggagaataagagggatttggagtgtaggtggagagggccctcaacagtgcaaaacacatcagcataaaccttataacaaaggtgataaacccatttcaaacagatgagggagttagttaagtagatatctgggggaaaaacattccaggcagagagaaaagccaaagctaaggcccaaggataggagcctgacttaagtgtttgaagtacagtaaagagtaaatgtttcctgaacaaaagtgaatgacgagagagtagtaacagaagaaacataatgcagtgaacagcgcatgtaaggctgagcacacaaaagtccaccttgaaaacgctgactttcactcttcatgaaactggaagcaactaaagttttgagcatagaagtgacataatctgtttcacattgtaaaaggtcattctgactctgtgctaaaaggtagattttcaaatccagtaatagaaacagagagttgctaaatccatttgagagctgattgtgtggtagtagaagaagagttgaagtgctgagaagtggttggatttggagtataagttgaaggcaatttcctgatggactggatatactgtctaggagctgtcaaggattgctctttcaagaaagtcaaggattgctcttccaagaaagtgcagtgtgaggaggtaaagaaattacatcaaggagaagatctgatactattaagatgcccgccctccccccacaaaaaaaaagaagaataattacccactagatgtaataacattcataatggcattgataagataaaacagtttctatgcattggtaaaggtgaaacctggataaagtggttttaattgaaaacgagaataagcaagatcagagtaattagagacagagtacaaccatctcatgtgagacgttgggcataaaagaaatgagtagcaggatgggaaatttaggatgattatttttcagttaaagagagtgtatgtttgacaatggaatgatccaataggttatacaaaattatggagtgcttttaatcttttctgaattgagtactgtttaaaggaagtatggatttttacctcaaatttaaaaacattttaaacttacttgtttatcataaacaattgtagacactgatagataatacttgctgacttttaaatcatcttccattttatatattaattttgtgcactctagtctctaaaaaatgacagtctgtcctatttctcaggaaaggcatggcagctgtcattaccacttctcacaaattgaaatgaaatgcacatagcacaccaaaatggagagttctgttttaaactgccaccccctaaaagatactgaactgaaatcagcaacttctaaaactatccttgtctccaagaaggtttcaaactactaatcattgaatgtttaaaatacttgaagtacaggtaaatatttctctgatatagtttctgatagaaaaaaaaaagaaacaaaaacatatagttagattatgtcttcgattcattatatattgttgtaattaataaggggcaagtcaggaaagtggaaatcacccagttatttcaacagagataatttaatagagagaaatggctaaaaagacatcggcagactgaaaaggctcaagaggaacactggagcaccacagctgtgaaggtctgaatgtttctccccaccactcccgctccctgccaaaagtcatgttgaaatcctaaccgcggaggtgagagtatttggagataagactttgcaaggtgattaggtatggaggacaaaaccctcatgagtgatgttagtgcccttataaaagagagctcagagagatcccttgagccttctgccatgtgaggacacagtgagaagacaggcatcaacgaggaagtggtccctcaccagacactgaacctgccagtgccttgatctggacttctcaaccttcctaactgtgagaaataagtatctgttgtttataagccacccactctatgctatcttgttatagtagcccaaacaaaccaagacagcaggtagcatagttactgaaggaacaaaggggaagagtttgaactattagaacatagacatttggaggaggccccctagagaaccggtacccagacttctgcatagctgatatgaatgttggcagggatgtaattaacagagtgcactatttacaattaaagatttaatgcccaatataaatggaagacgagccattggtaaagaatattcatagagacaatattgtacacaattaagcataatatatgacatgtattgtattttaccatgaataacatgttaatgcttctattggtgtattctacaatttgtatgggtgatagcacatagtatgtactatgtaaaactaagcctatgtagtagtagtatatatattagtggggaaaggtgcccctgagaagttgatgttgcccagcttgtgctaataccctaagaaattggaagagggaccctgaggagcttagatcagacctctgagtacaggtgcctgccatgtgtgctaatatatctcagagtgtgggaaaaatctggaaatggtaaccaaatgctactgataccatttagtaggtgcatggattaaaggaccatttttgtggcaacactggaaagaataggaaatgcaacaggaacaagtccctactttttcctcacgccttacagtcttcctccagtacttgtatcatagagtgtaatgcagagccagctggtaaaggagaaaggtagatttcggagcctcatacccagcatcacaaagcaaaatataagagaagtgatgaactgagagacaatggtttgttattcaactaaaattgtcatatatgtgtttggtccattgataggttaaaactctgttgaattgccacttttggtattacacaaattgatgacccaaaaaagattttaggatcatttgtgtgaattcagcacctaccgtatatgtgggaaatgtactgaataaacacagaaagatatgctttgttctcattctgacatttaaataaacctcacaaaggctttcctttgtttgccagagaaaaatcaatgcaaaattgtcaaatatattacaatggtctttgcccttctcttaggaattctcacctgacttctcttgcttttgctgcattgcataaaccctgcatatgcacactgtgccttaaaccattcaatgtgctgtcattgatgtcatctcatctgagtcttaaaagaattttgagaggcaatgagaaaaggtacagctcttctaagagggcaaacaaggatatgtcaaggactgtcaaggatatggtagagaagattttttatttgggacagatgacctttacagttcttccccaacattgagctttaataactggactgaccatgggtatgtcctcatcatattctgtaccaaaaatgaaagtaattatggcatcttcctagaggagattgttacttttaccttcacactagtatggttgcaagcatatgtcacctttgatatcacacaactctggtaccctatatagagaatcacaagaaaagaaaatacttgtgcttgtttacccccatatccacatttctgcttcattaaaaatccagaaaggtcagaaagcctaaactcacctggcttcactctccatttgtctccaggcatggctttttgatgccctgacagtagcccaagaaaacagaatattttcaagaaactcagcaggagtgaccttcagttgttgcctcattggcatatatttcttggtaaccagggaaagctctccatgacaccctccaggtccccaaaatatactgaatgcatgatgccagaaacattcacattagagcactatttctttctatggtgataatgggggttttgacctctgttgacatgcaaatatttctgaaagaagttccacatcttcttccctgagatccaattttgatgtgaatattgtataagaagtgatcaggaggaagaggctacttaaaagagaggcaaataagatagcctgaatggaaacaaatataactgtttttgcaaaggccagtgcctgcccataaatgtactttttcagaacaattgtcaagtttcttttcatccaccagggttgaggtgcttcctcaaagacactcttgtgtagtcaaggctcacctttatttcccttattgaactctgctcgtttcctttaacatctattttaatactgtgcaatggtattatatttttctgtgtttcctttttaactctagcactaatataaactttttgaaaattaggcttccacatccctcatttgtcattgttttgcaagatcctagcccagtgcctggcacagatatatgtgcttaatgcacttggctagatggatgaacaaatgaatgaataaatggtatgaataagtttcatatgctttttagtccacccagattccaatgtaccatatttatcagaaatgatataataaattattaaactttaattcaaaggtttatattcttattgatgtttttattatcagtaattcaattagtaggacatagtgggatattttattgatttttaagggatttaataatttcacattaaatcagcaataacaaaaacaatttatatgcttttcatgtccttaagaagtaataaaaacactcagctaaatgacaatttaataaggtgaagtttcatttgcaaatctctcgtttctttgagttcactctgacattgtcttctgtttccctgtttccccagtgacttcttatctttagtttaaaatggaaaagtgattaaacatgtcaaaacaaataactctacattttaggttttcaagtaaattaaaatttcatggacctcttaaaaacagacatatggaaatatctaataataactacatgaactgctaatggagtaagtttccaccaagcttaaaaaacacctttaatgtttttataaagccattttgaatgatagctgaaaaaaattaagttcaactcattcctaataatgctatttatgataatagttcttcagtgactttattctgcaccatggattacatgcacaaaaggaacacatatcgactgtatttgtgaaaaggaactacttttttcacactgctaagttaaatcccatcttattcagctgacctgcgattcagcacaattaacctgttcattagttgcaagtaaaatgggacatcaagtgatggtttaatgcaagcattaccacatctgaaaaataaatgtaggtgtttgtgtctcagagtgatttttcttcaatatcaaaaagcactggaaacgcctaaatctaaagcaaaacctgaatgatggagttttctgtctctatcattttcccttcctatatgtgccagaatgaattacgttcttgttgagcaactactagaggccatgcaccaagcaatacacttagaagataaggagaggaataaaacaggctccctgagcagaaagaatttattctctaaaggagaaaacagatctcaaacaaaaaattacaatacagtgtaataaaatccataaaactgatgtataaaagttgttttatgtataaaggaaagagtaacttgcttccctgaggattcagtggttatttgacagaggaagtaacatttgatctgagacataagggaaaggtcagggttcttgatttgggcaagaggatgagtcagtctaaacaggcaaagggaacagcattgacaaggtatgaaactgcacaacatcttcgggcaattttagaggtttctgaagcatgtgggccataaggaaaaagagcagaaagggcttacatgaattcaaattgggaagtcatgtgtatcttttaggggattcagattttattctatcgagatctattagaagtatataggtaagagaatcatatgatcgaatttgcatttcagaaatacgattattctggcattcttaacttttatgtttttaatttttaaaagataatatgcattattaacatatctacacctgagattagagttgaactaaaataaaattaggtgaatcatgtatttggaaagtcagatatacctatttatctttgatgttcagatattgtttgatttggatgcaatcttttaagaaataactttttaaaacatataaccaactctattcatttttaaacacagattaaatgcatcagtcttcatattaatattttaaatatgcggaacaaggtaaagtagtctcatctcgttttagtcaaccatatgttctgaaggccagaatcactgcatggtctacaaataatttttccatacttatgaattctcttatgtaatatgacttacccaggtgtacaaataaattccaattaatgatgtatctaatagactgtcatcattttgagtcatctaaccctatggtcacgcctaccaactcacaatatgtgaggagggcatatcactgcctccgaaactgataaatcttcaaataaagtgcagaaaccttaattaagaaattggtatatctattacttctctatgaatcatacttttttatatgatatgaatcaaagtttttttttggtacaaaagttgcaaaacagaagtgacataaattatccaatggttttggttacctggttgagaaaatataattggtaagaacctagaaacataaaaggtttgcttggataagtttaatattatttttaactatgcagccactgaaccactgtgactgacaaattggtttgtcaatatcacaagcaattgcaaagcgagatagctgttttcttaaatgctatcataaaactaggaagtgtttccaggataatttcagttgatgtaaaaataaatattcaatatacagaaccatacgtgatgttagtggatgcttatcaattattatatccaggccatttatttcatttatgttcatattctcaggaaccaaatttgtttatcaaattatggaaatatggaataaaatgccccagttaacctctggctcagaggataataatgttgctgggagtttataattgcagaagttttatccagattacaaaccagattgctaggtgcctctgtcactgtcaagattttattttttattattataggtttattttaattacaaccccctccttttattaattaagcatatgtttattaaacactagcagctttattgcatacaatatgcccattataggaaatttagatatttcaaaccctaatagagttcagcatttaataaacaagatataaaattgtaatatgatgtgttaagtactgtctgcatatgtatgcatttagaggcaactaaatcttaaaggggagattgtttacttatttttattgttgttgaggatgtaatatttaagctaaaatatgcagaggcataaaggaattaaagatgaaaagtaatgccatcaatagacacagaatgctcaaatgcacagagataatttcatactcagaagcctaagagaagaaagaagcaatgaatctgctgagtaactagagaggctgatcctaaagactttttcttgcttactaaataaatttggattatttcctaaaagtactgggaaactattgaaatattttggaaataacttagatttttagctgcgacattagacatggccagaaagggacattcaagagacagtgaacaggtaagtgtgaaagaacgtagtgaccagttgcaaggggtgggtaagcaagtaaagaggagataatgaggtctccctagtttaagacttgggtaacttggtaagtgatgttgatgataatattagagatacaaagtatagaaaaagaaatctctatggggatgatgaattctgcttaagacatgcaatatatgaagtaccagttgcatagcgcaactcagatttgctataaccataatttggagaatgtgggataaggataagtgagcctcctcctgtgaggctgttttatatcctgggtactgttgttcagctggcctatcttttgagcacatatgtgtatattaacatatagatatgtttatgtgtaattaaggaatatgtatctgtttataactatatacttggagccaagtatactggctggcactcagcaggaactcaataccaatatgctgaatgtatgtggggatccacccagtggttttccctaagaaggattttgctgactgtcttggtacaagttctcttgctttgattccaacttaaaagaaaagagctgactcatcattcagtattctctctctcatagggtacgctggcatcttcactgaagtatctgctaatctctttactagaacctctgttcacagtttgaagaggttaattttgcttcactcaaaattgaaatattttcctgtgaatctatccattctagcatgtcctttcttacctgtgatggtatagattttatcccaggagaaccttacaagtttatgtgatgagcattcattccaggaactctaatgctgtttccatttttatgaccaatatgctttgacctcctttctgttccagaacaaaaggagagcacagaaagggtggatattttatcataatacttcttcaaggccttgaaattgcatattgcctcctatatgctaccaaggcctatgctatgaatggaatctttactcttaaacagatcaacaacaaaaaccatacccagtgtcttgtacccttaaggcaaaaggcatcctgggcaatccctcaactcactttttgcacactcacaaatattctatctctcagtactaaagatttatcaatattcaactctgggacatgtgggaacacccatttatagatggtctactaaatggtccaccagtattcttatttagcttagtgtttatgtgactccatatatcactgcttaaaatttaatctttaggttatctgcagagcacatttagtaaaagaaaaatagcaatttgtcttttaactattattatgaataatgttgtacagtacaaaattaaaaaaagactgttttcataagctaatagttgttcttccctctgatctgttaataattagtcaatccatcattaatggcaaaggcaattcagcattcctccatgtgttgcacatgggtgtagacaggtattaacttagaaattgaaaatgtcttctgtggatctaattatgctgaaaatatttgtttataatagtccttttacacagtatttactgcccactttattttctttgttcccacccagaaatcaaaccacagaatttaggttggatagcatgttaggtttgggagctgttgtagtagttaaccagcaccctcaaagcattactcagtttcagcacatctagaagcataagcatcggtaattttggctaatgtatgtcagctgaactaagtaagcataaaaacatgtctgacatttaggaaaagaagagccacccactctcttacttaagtatatatattaataatgtttctcagcaatcatgttacacatgcacagtgacttctagcaatggagctttgcttctcgctcttgggttttcacgtcggctggggttgtgttcatgtctgctccatgtgcacttcatcctggaccagcagcttctccaggagtgctcttctcgtggcgatgataaacatgcagtgccctaggccaaatctcacaagtgtgagcctctgtcatgaaaactaggaaagggtgaaggaaagccagggaaatgaaattcaggctgtagaagcatcacatcccaggctgttatatctgcaagaacacagaaagttaaggagagtctcagtgtagttgatggtggcaagaaccagaagacagaggacaatgagtctcatgtcagaaaactcagaaaggaatggatggctaggctgtgcataaaagaagaacaacaacaatatcttaactgttatctccttaaaaggtctgaaaaattggaaaccagtctattaaacagaaataaataataacacagcaccaattactagtaacttaaaagatgtggcatatctttttagtatgctatttttaattgtttcagtgaatttaaaatatttataactactttaatgagttttattattcttttcttcaagttacttacccaatttctccttctaaatggttccttaatctcctatctcctatggtttgggaacaactacaaccttaggaaatcctctttattattctgacataaaattctttaggtcttattttgccatgcaatttttatatggctatcttattattccaattaaaatttaactttaagtcaggcaatgtgtgacatcctctatggtatctagaagagagctcacaagttaggtgtgaagaaatttctataaataagtatgtaccatatcaatgaaattcatgagttctgggatttgtaaattggacatctcaaatggaagaacagagtagatggctcacacccccttttcccattttctacattttctgtttttgaacaaaatcatcttagtttttcccagcatcagacattcacttgtataagattgaatttacaaaaaaatgagattcattcgaaaactcaggataaagcaaaattcaaggagaaaatgaaaatctgttctaccataaatccctccacaactagagagatacatattgacttttttggtagcagagacttacgtgacaggtgtttatgcctgaactgttccacagataaatggaagactttattctcaagtgatcctggcatactcatgtggaaaaagcaaaaacataattgaaagaacgttatttcattctcctattttggtaagttaagaaacaaagggaactgtttgtaactatttcttatattttgaaagccaggtgtgacagttgacattatttactaggactgagtttataaagcagacccaatagaggctgcttattcattgtgagacatcatgcctgcagctgcctccaggtaaatggtgacttgtcttacaatgcataaaccaagtagttaggctctgcgccaagcaggacttgaaaagacttatagaaagcacatggttcccattcagatgtgcttttattttttaaaaagtactaaaataattattgcatttattctttttatgttttatttttaattgacacataacaattgtacatatttatggagtacactgtgaaccataagagatagttaacataaggaggaatacatttaaataaatgcaatatttaggtctcatggatttttagaattgtaagcgaaatttaaggttgcttaggtaacactcttcattttaaatattagactgtggaagtcaagagggattaagaggttagtttttctcagtttaaactttattcccttccccttgttgcagattctaaatatgcgcttttcaaattgaggggcgaccacatcaactggctacaattgtcccctctgtgatttttgttgtgttttaatgctccaggctggatctcttctgctactttaaagatttcaaatgagacccaatgcttgagaagaaaatttgatgttttagaaatcattttcatttcttttgatgggaaaataatttctttatacacttaatttcattacctgaaacacttgtcaaagaatgactgaatcttataagacaattacttgacttagttgtttcaaggaaatctattgagttggaatatcaatctacatattatttgaaagcttgaacaagagatcctgatatagatccctatttaaaaagtactggttaagtccaacatccttttatcaaaacagtgggatttaaaatccaaagtattttttgatttttttttctttatggccattcttgcaggagtaagggggtattgcattgtggttttgatttgtacttccctgatcattagtgacattgagcattttttcacatatttgttggccatttgtatattttcttttgagaattgtctcttcatgtccttattctactttttgatgggattgttggtttttttttctggctaatttgtttgacttccttgtaaagtctggatattagtcctttgtcagatgtatagattgtgaagattttctcccagtctgtgggttgtctgtttactctgctgactgttccctttgctgtgcagataagtcccatctatttatctttgtttctgttgcatttgcttttgggttcttggccatgaaatctgtgcctaagccaatgtctggaagggtttttctgatgttatcttatagaatttttatagttgcaggttttagatttaagtccttgatccatcttggatcgatttttgtataaggttcagtttcattcttctgtatgtggcttgccagttatccagcaccatttgttgaatagggtgtcctttcccaacttgatgtttttgtttgctttgttgaagatcagttggctttaagcatttgggtttatttctgagttctctgttttgttccactggtctgcatgcctattttataccagtaccatgctgtttaaaaaaatccaaaaataatagatgttgacatggatgtggtgaaaagggaacgcttctacactgctggtgggaatgtaaactagtacaaccactatggaaaacagtgtggagattctttaaagaactaaaagtagaactaccctttgatccagcagtcctactactgggtatctacccagaggaaaagaagtcattacatgaaaaagatacttggacacaaaagtttatagcaacaaaattcacagttgcaaaaatatggaaccagcccaaatgaccatcaatcaatgagtgtgtaaagaaattatgagatagatagatagatagataggtatggaatatacactcaaccatgaaaaggaattaattaatggcactcacagctatctgaatggaactggagactattattctaagtgaagtatacaaggaatggaaaaccaaacatcatatgttctcactcataagttggagctaagctatgaggatacaaaggcataagaatgatacaatggactttggggactccggaggaaggatgggaggcgggtgagggatcaaagactacaaattgagttcagtgtataccgctcgggtgatgggtgcaccaaaatctcacaaatcaccacgaaagaacttactcatgtaccaaataccagctgttccccaaaaacctgtggaaataaaaaatgttaagtttcttgtgcgtccgtgtgaagagaccaccaaacaggctttgtgtgagcaataaagctgtttatttcacctgggtgcaggcgggctgagtctgaaaagagagttagtgaagggagataggggtggggccattttataggatttgggtaggtaaaggaaaattacagtcaaaggggggtttctctggtgggcagagtgggggtcacaaggtactcagtaggggagcttttgagccaggatgagccagaagtaggaatttcacaagacaatgtcatcaattaagacaggaacggccatctggatgtgtacatgcaggtcacaggggatatgatggcttagcttgggctcagaggcctgacattaagataataaaataaaacaaaatctgaaagtaaaattgtttgcccagtttttaaacaaacccagtagtagttttgttatatctagaattaccccatcactgtaaggctgctttgtttttttaatctcttttcctctgaacaaccctgacaaaaatcggatggaaactgacattttcctttctcaaccatgctcatccatgcagctttgacatctacatgaatggttaatatcattgattcttgttattcctgtatctattatgctctcacatgcaaggatcttcatgttctttgccaggattcccagaaagatgctccctttaatattaactggtcaattttgataatggagttgatttttctttaacgtttataatcactgtaaacttcttgacaagatggtgctattataacactgactgtttctgccgaaagaagaatgttcagtactaagacatttctgccaaacgttactacaactttgaaaagcccttcctctggcttgctaggaagctcattggagaccctaacttggagtttgttgccatgcctgcccctgccccactggaggttgccatggacccagctttgacagagcattataagcatgacttagaggttcttcagacaactgctctcccagatgacgatgatgacctgtgagaatgaagctggagcccagcatcagaagtctagttttatatgcagctgtcctgtgatatcagcggagcagggtatgggccaccttattattatctagctaggtggggcatgtggttcatctgtgggatgctgaaggagatgagtgggcttcggagtgaatgtggcagtttgaaaaataccttcattgtttggacctgcatattgagctgttttggaatgcagttgattccttcttgagtttcaaatgtaagactgctgcaatcacattagtgaattcaggggtgagatcttgttactgccatttctactccttttcatttagaatcagaataaagttgtatttcaaatatctttttaaaaatatatttacattatatgtgtatatatacatatatgtatatagtatatgtataaatttacatgcatatatatacatatatgtatatgtgtgtttacatatgtatatataaaatgtatataaacatatatatatttatacatatatatgacacatatatgtataaatatatctatgacattagacataatgtatttctatatctaatgtcatgcatatatttatacatataatagatatataaatacatatatattaatgtctacatttgacattacatatgcatgtcacttgaaaatttgtgtatataaaatatatgtataaaactcaattcaaagatatgtttccagtgatgggtcttgtcaatgtagacatttaaaatgatatttgggaattactgatgttattttaagagcttggtatgtcagagattttcaaatggaagcagttgctatagtaaatatggattttctcctaattaattcagacattaaaaagttactaattgcctacttttttcctaaattgcttctggaatataaatatttataatcttcataatattcccatctgataaaggttaggtttgatttcactttctttctaaaacatctgagcattttcaggctctaactccaaaagaacaaaactcgtgaagatttaaaatattttaatagattatattggaattccatttccattatattgaagttactttttccattgctatcatattaggaaaattaaatttatacatgttctatacttaaagttaagttttagaagtatcttttccctaattgttattgagaaattaattttaatacacttttcatctttccaacagactactgcaaacaaataataagctagaagtttagtttattccctttcctaaagctcttctataaatattgactccagcaatggaaaaagcaaaagtatagtcagcattctgtatcatatatgacatatagaatatagaataggctataccatcaataagataaatcagtgcctttataagaccaaatgagtatatcaatctcagattaaacaatgcaaagcacttcgttcaagtggcattttcaccctttcaaataactccactaaatatataatactcatgaacactaataaaataaaaatatatgtgttactcttctgtatatatctgtaaattgggctccaaacactacattttccatttatctatacgactctaatgaaagcatcttggcttaagaaaactaatagatctgaggtggtaaagtctttattattgaatcacagaactttgcctaaatgcgaagttctagcttcaagttaaaaaaatttataaatatttcaacatttaatttagatacagcaggtacaagcacaggtttgttaaatggaaatattgcatgatgctgaggattgcagtatggatcctgtcacctaggtagtgagcattgtacccaataggtagtttttcaatcaacgccctccctctttcccctctctagtactctgcagtgtctactgttcccatgtttatatgttcatgtgtgtccaatgtttagctcttacttataagtgagaacacgcggtatttggttttcttttcctgtgttaattttcttaggataatggcctccagctccatccatatttctgtaaaggacacaatttcattaaggaaggagggaaggaaggaaggaaggaaagaaggaagggagggagggagggagggaaatctagaggaatggataaattcttggaagcccacaatctgccaagactgaaccaggaagaaattcaaaccctggatagaccaatatcaacttctaaaactgaatcagtaataaagtttgggtctttcttaaaatttctattttgcctttcagctcttaaatgatattactggattgcttggtttccttgaattgaatttcaacgtttccctggatcttgatgtgctttcttgctctccagattctgaatttcatctgtctgtcattttattaatagttatttaagattgcttaagaaccattgctgaggaggtagtgggctcgtttgggggtaaggaggcactctggcttcttgaatttccagagttcctgtgctgattctttctcatcttggtgggtctctggtcctttaactgtggcagaaattgagtatagtcagttgacttcatttctggacattttcagaaggccacacaagactctgtgcaggggtttttgtttgctgttgaattcttgtccttggcttccaaggcgggtgaatggttttgtggtggtgtagtttggggtgcaatccgtagatggtgctttagagctatgggtggtagatggatactcagcgctggggactgtgtatcctcgcgtgtgcagctgtgctctgaagtgtgagggggagaggggtaaccccctcaccagttccactaataggccttcggaagccactgctgatcaccggcactgtgccgtggctttgtttgtttgtttgtttgtttgatgtttctggctgtgggcttccctggggcaggtgttgggcagggggatagaccacgcccttactgggccagctctgtggaaggaggcattccaggtgccacaccagcctgtgaacctgtgcatctcacccttctgagtgtgggctcctctcctactcaagttccgagcacaggtaccagctcagcactcctgagccataggatccaaccctgcagtgccagaacctgctcacggctccctcctctggactgggttgggttgggttctgggtgtgctggggatctaaggggccgcaggctgccagaacacactccagtggaacacagcacccaggctgggcagcagacgcttcactgtgcatgtgctgctgcggggcagccaggcaggagccctgggaggggctgacaggcaggcggggctgcgggacagatgtgcctcagtgccgtggggaagctcgccctgctttctcccagtccaggagttttctggggccagggcctctcagagggagatggagagccctgagagacgggtgcctatagctgggctctgtcagatctgttccacacacaaatgtccccagctccatgtctgctgaatccccgcctctatcaaatctcccaggagatgcccctgccagctcaaacatccattggggttttggggttccctgcagctaggatcccagaagtctgcatgagcgtgggctgtcccccaggctcttcactcaccccttcctcaggagccatttgaggcccggaatcagctttagcattcaggcacctcccacagggcttccagcctcctcttgcttcagccttagcatctgcgtgttttcttcatccacattcggtattttctctctgaagatctttttaaattacagtggtttagaggtggtagcggcccttcctggctgcctctagttggccatcttaaaactcctctcctgaaaagaaaatgttatggaaacatgaggagaacaaatgcctgcaaggaaatcaaaacagtgctgtgacaccattcagtgtcagctacacaaaagaccaaaaagtgaagctacctgtaatagactagaatctgttggttaaccaaatggtacagaggtcagtttacttactcctaactggtaaattcagtttataggtacagtgtttcagtgggacttaaatcatgtagttggttcagctttgttatgaggatcgtgaaatacctctgtaataatttcatttctgccttctccaaatatacatgtggtatatgtcatgtaaattaccttatatatttaagaaaccaaataagaagtttcgagcttggaataattcatgtgagctaactagtttctgattaaaatagcatcaggaaactgagtcaggcattttttttttcatttgccattccctgtaaattgggtattacatcgtgatcatgaaacttaccagtgaaatatgttctatgaaaaaaacgagaatacctgcaattaaataactcaaaatgccattcatttaaaacacatttattatatgcccagaattttcaagatactatgcaagacactgtcgggaatacagagatgattaacatgatgtttctgccctctctggatatgatcttcactaatactggttcattgtaatttccacttttattacctttcttaatgatgatattctcagtcggtgattttgaagataagcagatttctcgatgactatttaatgcataccaataatagctttatttttgttatgtctgggtaaagaaacaaaggtttatttcttttccttgacatttatagcatcctatgtatctgtgttccatgaaaggttacctaaatcacatttattccaaatgggcaatatttaactttaaaaatgtcaaaggaagggtacaattctctgtagggcaatattgaattggttgactgaatgataattatggaataatgcattatgcattctcttttcatttcaaatattgattaatattattgattctaaaactcatttaatctgttattcagtagaatcattgccatatactcacttaccttttaattttgatgttgataattaattgaatcaaatattttttcagagtcatttgtaacttcatggttataatttctcaattcatgttaatgtaagctttgtaagatatgccattgttcaggtaattatgtataattaggcacaaagagaaaatagttacctacctttaaaaaaaagccatcaagatttttcagttgaaaaattgagctaaaaacagaattagaaagatttcttggagctaaactcaaggatctaaaatgaaggatgagctcaggacattttgtaatttaatattggactcatatgcacgagttccttgcaggagctactcccactcctagtcttgactacaagggcaggtgagataatatctgcattgtttggtatatttaaaccctgcttctttaagtgttatcatttaccacaaaatatcgtaatataactgtcacagaaagacaaatcaagaagaaaggaaagaagaaagaatacatattgattgtcagcattaacacacaggctataatttgatgtaatattcaactctatactttatggcaaccaagatacacaagaaaacacaacatttacatagatcttctcaaaaagaaagaaccatacctgaagaaataaatgtgtcttgatggtattaaagtctgcactttctcacttgagtcctaaaacagggaaatgagcattattcccaacaactataataacatatttaaaaatggatttcttaaatctgatgacaaatgtttagaactaccatttacataagccaagtcctactttttttttttaacaaatcctttctcctgtctcctccagatgccattgccattttaaatttcctgactgacaatctcccaacttcccaaaaagtgtttatgaagtacctaagaaacaatttgaaacttataatgagatccagaactagtactgactttgaatccattgtatggagggaatgttattacctataaagcagatgagattagatttataaaaacaaatggggatcatcaggatgttgctaccagaaagagacccagctggcatagacacctgttagtaaaaggaaaaacattttgtgtatttcgtctactgacccccacttcagaaatgctcgatctgtataaaccgtacaactagacaggcattcacctggtggatgctgatattctgaagtagccagagtgatttctccaccctaaataaaactttcttccgaatttcattcagagatgacaaaaatgaggaagtgaagtgggatggggacatcacaagtgggacattgcatcccgggaagcaaggggactctgcacacgttgctgctaactgcagcggcacctgaggtggttctgaccgctgtaaactctgtcacagaattggggagtgagtatacatggagaaaatttgttttgagtacaatttcataaccagaaaatgatacagaatcatgtaaaacaccctataattcaagggcatcaatagcaagcatagggaactgattatgcctaaaacagaggcaggtcctctatattcctccctctgaatcatgtatgtcctcaaaaatgtcccatcagcacaaaaaaaccagcaaaccacagtccatcctgatagcctcctttttcatattaatagcagcattatactgtagtttttctgtctcaaaaactgaattttttaaaactttcattttcttccctatatctgattacttgtcacctccctcccaaactcccttacatatgtaattgtcttttcccatggtcaccatatccaagttctgattaccttttaataaaatgaatgaattagcttcaacaatgcaatttcttatccaggtatccattctttcaatccttcctaattttgacatacctgtagtagtttcaaagcacagatcacatcgtgacactcctgcttatcattttcaatactactccattgcaaatattaagaaagcaaaactgagagccagacaacacccaacagatattgtctctcaatccttacattcccatgaagaaaggatatatgtaataagagagaaaggaaccgtgacttagaaactctataaaatataatccacatagattatacatatgcttatggtgatattactatactgactttacggtgctttctagaatttagactctgggccattttggcaaaataaggagcctgcagactgcttatgcctttgaagagaaaaaagaatgtgaaagatgttatttttgtgatacatcaagagagaatatgataattaatattgtatttttattcatgatggaaataaaaataggcaaacactatatatgctgtaaacctttggagtactcctttgtcgcactgggaacatggtaaaatatataattttttcatagatagatcgcactataagagacaataataatggaaactgtcatagttccctgaaattcaagttgaaatactatttacatcaaccataccgccgactccatcataatgaggaaacatctcagggattattaatggggtaaatttcactatatagagaaaaaagacagataaaaacatgtatatgcccaaacttcatttgaaaggagggcatgtagggaaaggtagattaacagctgaacttcattagccatttacagaaaagttaaatattatatctaggatacatttgtcttaaatcacccaggattaaatcttccaagattaaggatttcatctaatcaatttcacctaattgaaatatgcagcccttctgctctttttttgtaactcctatattccctcctatcctttaaattatttttcatttaaaccattcagcagtttaaaccattctagactactctggcctgaagtacttcatcagaaatctttacactttagcttaaatattcatttaataatgaacaattcatcttctattaaatgctactactcaatttttgtttcaaactatatgtacatttcttgttaggcataattttatatatttattaattggtttcccttccaagacacagaacctgcccttccctcccagtgaaaccactatgaggtgaaaaatagtgttgaagaaggaagagggacacagagaaagaaataacttcacacatctatttaaagatggccctgaggtccacccacagcatcgcagggatgagttcatgagggagtatgcagccacaatacctcttaactccccatgacttccttgagcttccttgtgtgggagtagaaggttgatggaatggttagcctttcctggtatctgtgttcatcatggttctcagcagatccagctgcataaaatgtctctatctgttaggatcaataaaacaagctctctaactgctctataatcagcatcaatttgcgaacctttatcaaacttcccccctcttttcaccaagtattcaggatgacatgatgaacaactggaccaatgattggtcaaacatatcctaatatcaaatactggcagttacctggagtaaagaaggacattttgtgtgtccctactttaaacgagatccttaaagctttttgtatggctggtctgagtatttaacagaagtcccgtactcataaggatggctagacctgaaaggagcctctcacctgcagggtaatgattcggtttaatgaggaccttttggaagttacttggctctaaggccagaaagcctaactgagatcaagacataattgaataggaattgaagatccatttacctcatcagttggaaaataagcatttttcaaaatagagagataattaaatgtggtcccttcagtgctacggattaagttagtattatagttttaatatacatttcaaacagtttccctcttattctgtcataggacattgcaattaatttaatcaacctttaaacagacatttaccaagaatttatgataatttagatattgtgcagatggatgttcaatgactttttcttcttaagtcaaaatatttaaattcttcaaaatagaaaatgtgtaatatgtgctgcatattatatgcctttttcctctttcccagaatgccttttactagttttgtgaaataaacaagatagattatatcttatatacatatgtataatatacttacatacacacgtataatataatatttataatataatagaattatattctgtattttatataatatataatagaattatatattatatataatagaattatatattatatataatagaattataattataatatataattataattatatagaattatatataattataattatatattataatatataatagatatagaataattataatatataattatatattataatatataatagatattatagaataattataatatataattatatattataataattataatatataattttaataatataatatataatagaattataattctaaatataattataattctatatataaaattatagatataattctatatctataattatatataattctatatagaattatataatatataatagaattatattctgtataatacatacacacgtataatataatagaatcatattctgtcatcttttcacttcagtctatctctttctgtgtcattttactcctttacaaagaccatatcttctttaatcctgctgagggaagcaacttaaaaataactttgatatggtttggctctgtgtcttcacccaaatctcaccttgaattgtaataatctccacatgttaaaggtggaaccaggtggagttaattaaatgatgggagcggtttcccccatgctggtttcctgatagtaagttctcacgagagctgatggttttgtaaggggcttcccctctttgattggcactcatttctctctcttgctgccctgtgaagaggtgccttccgccgtgattctaagttttctgaggcctccccagccatgcagaactgtgagtccattaaacctcttttctttataaattacccgttctcaggtattgcttcatagcagcatgagaacatactaatatgtacttctagcttctgtagtcaatgatttctggatacatactcttcttctaacactttaagataatattcctttctcttcatttaaaaatatgtaggcaacttcatattcttctcttcaaaccaaaatataggggaaactgcatagacttggtgtttgttggtaggatggattgctttctgcttgcagtatgtgaagcccattcagggttgagggagatccagtttcagcacatgggtaggctaattcacgtaactcttacttcaatttctaatatccaaaagcaattatgtagcacaaccctaaatgggtaactgaggtgggatttttttgcttctgctcatatccaccatacttataaaaattgaaaataccttacgtctaggctgtatgatcctgatcacccacctgactataatacttacatgcagagaatccactaatttctagcttacccctcaactctatctgtggaaggcagaataatgccccatccgcccccccaccacgaagatatccatgtcctaactccaagaacctgtgaatgtgttgccttacatggcaaaagggactttgcagatatgcttaagattacagaccttgagatggagagattattgggtttatccaggtgggctgagtgtcatcacatgagtccttcaaaacggagactgtttattatctgtggtcagaaaatgataggtcaaaggaaggaggcagaagaaatctgaagtgtgagaaggactcagtctgttactgctggtttgaagacagaaaatggtggccaagagctaaggaacgtggaccccatttagaaggtggaaaaggcaaggaaacagtttcttacctagagcctccagaaaggaatgtagtcctgccaacactgggttttagtccagtctgacttttgctggacctctgacctacaaatgtgcaagataatgaatgtgtgttgttttaagccactaattttgtagtagtataacattctggagtttaagagtctgaatggatacttaaagatagaaagaaatgatacaacatcactctgcccctcttacccaaatactgtctatgccctaggaatggctaccctgattttctcattagtgcagtgtccgggtctctgaaacatggaggagaaaataatgcaagaataaagtgcctttgaccatatttaagctaagagaactgctctgttttatgacaaagtagaggaatttttaatttcttgatgtaggttatgttcgacctttagtttgaaaaaacaaaaaccgttgattaaggcagtagttattatttttaaattttttagtcactgtttgttagcatattccatctgttttggcaagttcattgtggaaagatgactctgttaggattaaggactccagataaagcaggggtctttcattttcatcagaagactgatcagggtgctggagttcaggggctagctgagcactcatcccaactgcagtgctgtggccttgtgattgtcatctaacctttctgagactccatatccttactttttaactaagcatactctgttaagtgccgtcttaagagtcttctagatttctatgcctgtaattccaataaattcattaattctttcaacaattatatagtgaacaattatatatcaaacttggaataacagcaaaaggttcttcaattttaagaaacaaaatattaagactagaagcttagttggatattgtggtatatgcgataaagaaaagtaaagaggatgttatgttcaagattattgaaagtggttagggaagtcctctctgaggagacaatattataatgaaacaagcctacagaattagaagctcccagtcttgcaaatattggaggaagaaaactccagacaaagaggaggctaaacacaaaggttttgaaataagattatctaccagattctaggaacaaatggttgacctgtacacccaggcttggcatgtgagtgagaataatattattataaacttagagtgaaaccagttgacccattttgttatcttttacagataaaattcaccaaaagggtaggtaattagtcttatcaaaatcggttttatttacaaatatgaaggatggaagagtgggcacaggagatgagagcctatattaagtagttggtaactcagtaaacaatggagtctaggccagacaaggagggagagaaatataggaaaactccagtggttttgggaaagaggatagattcaaaacaaaaactttaaagggttacaatgatagttatatgggtactagagtaagtgatcttgaggacaagaggcatttttgagaagaaaatgtttgaaatgaagatgcaagatgtgcccctgccccaggttgtgacaaaagtgaattgagtccataggaacaggtgtcagggatagaggatgcggttgtttgagggagggtatcaggacctgagaagccaaacttgatgagtcattttacgaagggtgacctgttaaagaatacccaggaacaggcctggagtagtcctgaaagagggaggcaggtgccatggactaagggaccaggaaggtgcacacaatctcacaagactccagctgccatcacccatgttcatttccttgaagaaatcatcttattccttaatttttccccaatatatagtttgagactttctgattctctttctataaatacaaagccctagagatttttattatctggtgatccaaccctttttggagtgactaatcaaaaaagcacatgacagtatgcatattttataattttggaaattactcttcctatttacatatactttggagtatatcacaactccaatttagtacattttgttattagataccagaaaatcatgagttcatactacagtccctctgctgccccatttccaacttaaaatagaattaccaacttaaaataggagaaacaagcttaaaatagaagaaacaagccatcacttaagtagatatagaaatatagttgataaaatttaacacctgtaccagataaaaatttagtaaactagaaatagagctttaccttagtaagagcagccattaaaaaaatgcatagtaaatgccattgtatatattaataatttcatttaaaattaaatatgtgacaggaatgcctactgaagttaccttcattcaatttttaactagagatccaagccagcatacttgtacgctgtactgattgaaatgacaatcaaattagtggaataaaaatgggaaaaaagaaaatgaactgtcattatttgctgatcataaaattatttacataggaagctactaaagaatacagagaaaacattataaaatagcaatggatcagcaaaatggttaatataaaattaatatatagtagccaattgcatttctataacaaacacctagaacacaaaattaaaaataaattatagcttaaaatatgtcagtaactattttcaaaatattttgaaaaggaaatggcagggaatatttcacaggtgggaatagtatatgcatgggacaatgagggcacaatttgaagtaagtcactataagccaagaagcttcatgataaagctgactttaggaaggttaacctggaagcaaagtaaaatagtttgagctggggggacagcaggtggcccagagagaccagaagccggagatccgggaaaacacatctccaaagggcacagaggcagagtgaatggactgaacaggagagaattagacctcacacctttcttgaggaaggtggatctcagtgcatattttaaagattagaattcacatagatatattattttactagaaaacattttctcatgtctaaaactttttaaagcaaaattacttaaaatctttggtaagttttaaaagtttagataatgtaaatgtttatatacttttgaaaagtaaactaagtattacctttaatatttgtaaactttcataacctatcactgatatttactaaagaagagagtttaacaacactgagaaatattccaacagaaaggtgaactgttttgtttttaagcaggtgaagtacaagaagtttgatggaggccattttacttaattaaaaacttcatcaaaatgctgttttcactatctgagttgtcagaatttctacaaggctttttcatattcagtcctttcaaaaatataaaatacttgaaggcagttctttatagaagaatttaaagttacatgtcaaatgtagctcttctttttttaattactgaagccatatatggtcaagagtaacttcaggctggccgcagtggctcacgcctgtagttccagcactttgggaggccgaggtgggtggatcactaggtcagtagttcgagaccagcctgaccaacatggtgaaaccccgtccatactaaaaatacaaaaattagctgggcatggtggcatgcacctgtaatcccagctactcaggaggctgaggcaggagaattgcttgaatccaggaggcagatgatctcagtggcctgagatcgtgccactgcaccccagcctgggcaagagagtgagactccatctcaaaaaaaaaaaaaaaaaaaaagaaagtaacttccacattaaacaagagaaataaaaacaaaagcaaagttctttgtctaagcaaagcctgttaactctaattaaccagctttgcacagctgtgatagtacagcccattaattattaataagaaaataatcaatattaacctcctcttttttattggtaaatgttttttggggtctttgtgttaatttgttattttttaaattactgttttaataaatttcattatagatgctggagtaattacattacctaaaaataagatatagtcatgtagcacattactttgaagagaaaaataatatttgtaactttattaaccctatactaagcacattagtttcatttttgaaccttgaaccttggtatttgatttgcagtcctttccaaatatttaaatttccatatttactctctattctttactaaactctactcattgccttagattgaaacctaagtatctttttaaaaaaaaacccttttatgtggctatagaacagaattaggaagtttgctaatcttgaaccttgctttcttaaatggtatttttgttcattctcttcctaaactttatttttttattatttctctgctttacaatttaataagccattttactggagcttcatactctactttctatatcatataatgggaatagttttaatgcttgtgaagacagcatgtattcagtacacaaagatgaaaataatttaatcatcttcatacttattagaaatacttatattattcagtcagtaactgtgactattgaacttatctcccaaggatattataaaaataaatgtgataagagctaaagaaatttttaaagtcatcaatgattcattttaatctaatttcatcactggaatttcttgaatgttgtaagagtttatgttagtgtgtcatctaatcatagttactctaactggctagcagcttagaacaagcttgaataaggttcaaactaacagtggatgactgccaatggttagaaaaaaaaaaaggaaacattaagctacttctaatctaaattaaaatacaaaaaaatcattaaaatctacttttattttatgtcaaaattgtatctcagatactctgatttttaagtcatcaatactgttttgaaaactggacagaaatagtcactggctaacagctaaataaagagattaatcataaataagcactatctttaagcagctcacagtctactaaagcctaattaagatttataattagaaagttaaattatacagcaaatctcagacttggaggagtcctttacaccatctcgtccaaccactccatgacacagatggccaatctgtacttcattctcgttagttgccttttcagcatgccagagctattcattgacatattcagccactttgttaaataagtgtgtgtgtgtgtgtgtttttccttacaagttgagtgaaaaattaaaatgtaacaaaatagtgtgaaagcactaatcccctattccctattttcttagtctgaagcttggtgcaaaggcatcaatatcacgggcttgggattggtcacagttgagttctgtgacccttctctgtcacagactgactctggggatagtctccatggtctcagaatggagattactacctgagctgcaggaggggaatgctacctctgcctgctaaaattgttgccacctcctattgtggctgaaacatggtacttgcccagtaaagtggtgcctactatagtttttatttctgtatcaagctaaacacaaagtaaataatctggcagtagtgatcagtgatgcattgtatttactatacattaagaagaatttgtaggtctttaaaaacatcacagggatgtcatctattgcaataaatgaaaatgggatatttaattacccattaaaaattattagaagaaagagtgactatacttcccaaatgagtattgataagcctgagttcctgtaaaatggcctcgggaagctttgccttcatagcttctacattcttcacctgaaatacaaatgtgggctgttcaaagatacataggaaatactttactttgaaactgaaataggagctggggagaagtgtttctctggagggactggatcgctcctaaggctgcccaacttgtgggttttccaatgcctgaggtctttaccatttaagtcgttggatttggattttctcttgctttaaatcagaattattttatctgaggcagacagaaaaattctcaaaattgagatgaagtttcatctgatgcattaagagagtatatagaactcttgtatacttatatactcttacagactcttgtataaactatggcaaaggattctttaagacagaggccaggtaaagaacaaaatgactgaaccagactgaaaacacagcccacaccagggacagggactagtagcatcaggtgcagaattccaatcatctcctggcttgtagaaattcaaattaagatagcaacaagtacactaaacagtaattgtgagtcagcacattaattggagaggaaatgagggaaggaaaagggaaaaagagagaagttggaaggagaagaaagaaggggatgggaggaaagaaaagaagggatcgcaatgtacttaaatgtccaaaacgaaccaaaaatgttaaagaaagaacatgttgggaaaattcaacacttctaaatgctgaaaacaattaacaatggaaatgtaaaatgcttggaaccaagtgatccatatctactacaaatcaaagctaaaacattggtactattgggaaaacgttggtaatgccagccatgtaaatactgtctatataaaataacaataatatctaacacataggggaggaaaaagccacttaaatgggcaaaaataccctgtaaaccaggaggacatctaaaatggtttatgtggggaatgttatcagctaaaacacttacattacaaaaggaaggctaaaaattaattatacaaatattaatcttaaaaagtaaaaaagagcaacaaaatcccaggaaaatagaaagaagtaatataaataagaacattagataaatgttaataaaaagaccaaaagcaaattatttcataaagaccaattggtataaatatattcattaataatcataacatctttagataattatttagcattatcaaataaagttgagcttgcacgtaatctacaaatcagcaactctacttcttttaggtatatatactagagaaattcttggatggaggcacagaaaatttgtatgaatatgttcatattaacattctccataataataaaacctggaaacaaccaaactgtttatatcattatactatcagcagtagaatgctaaataaattatggaataatcaaattatagaatatgacccagtgttaagactgaattaaccacaactacatacagaaatagagatgaatcttagaaatctaatgttaagcaacaactttaaaaaaccaaaattcagaatactaggaacactaggacactatttttataaaactcaaatgagtataaaacaaaacactatgcaatgatgtggtttaggtgtgtccccacccaaatctcatcttgaattgtggctcccataattcccatgtgtcgagggaggtacctggtgggaggtaattgaatcatggggacaggtttttcctgtgctgttctcgtgacagtgagtaaatctcatgatatctgatggctttataagggagagtttccctgcacaaactctttgtttttgtctgctgccatgtaagacatgactttgcttcttttctgccttccaccatgattgtgaactcgctaaccacgtggaactgtgagtccatcaaactctttcctttataaatcacccagtctctggtacgtctttattagcagtatgagaacagactaacatgtgcatatgttaaaacgacattttgaaagggaagagaaggaaaatattacatttcagaatagttattctgggtgaaagtgaagaagatgggaatggaaggagacactgggagcatcaatcttaatgcttacactaaattctcttgttgggtcatagactcaagaggatttgtttaattggtatgccatataatctaattattaataatatatgggttcttctgtatcaagtattacataataaaatatttttaaaggcatagaagatcttttctgttctgtgcctcatataaattatctcatttactttgaagcaaacttttgaggcatttattattgccctcattttaaagatgaggaagctgaggtttagagaagccaagaaacacagttcttgagagacatagctagagttcaggtctgtaccgtagccccttcctttaaccattacactgtctttctccatttggaccctttatagagggaagatcacagcactgacccctgttctcattggagtaggaggtgctgagagagctatgtaaaaagtacacactggagagtggaaaattttcacagaaatattgacacataaacttaggcaaacagaaggtagaaaagatgtttcaccaccaaaaactgtccacgtagagatgtggagagaaccaagaacctggaggatgtgagcacagtgggccttctggcatggcagaagcagagggaagtgaaggagggaacagcagtgctaaggatagaaatgcaggtttggtccagttgaagaaggcacttgatcttttcgggctgaccagtaggtcttaaactgtagtgcatattgttatcacctggcagacttgttaaactgaaggttgctgagccccattctcaaaatttcagactcaataagaatgagtggagcctaaacatttccattctaacaaatgctcaggtggaaatcactttgaaaagcaaagctttagggctggcatataaggaggattgcttttagaatgtcagtgatggtgaagctgtggagaatgggctggggagaaagaatgaacatggagagtatagttaagccactgcaggagctcaggtaggtctgaaacagtggtggtggagatggagagagagtgctgcagttgaggcatgtctgaagtctatgaacataaagtagtaaggcatgagttgggggcataaagatagagaggctcccaagctcctgccagaggtactgagtgaagagtagactcattaatcaatgcagggacaacagagaatcaactcaggtgcccatcaacggtagactggttaaagaaaatatggtcacaaataccatggaatactaggtagccataaaaaagaacagaattatgtcctatgaagcaacatggatgtagctggaggccattatgctaagtgaactaacctagaaacagaaaaccaaatactacatgttcccacttgtaagtgggaactaaacattggggacataaatatgggagcaatagaccctggggactgctacagcagagagagacggattggggcaagggctgaaaaactgcctattggatactctgctcactaccagtcacaccccataccttagcatcacactatatatctttgtaaaaacctgcatctgtacccctgaagctaaaataaaatttggaaaagaaaaataatcgatacataaaataaagagttatgctggctcacacctctaatcccagcattttgggaggccaaggcagatggatcacttgagctcaggagttcgagatcagcctgggccacatggtgaaaccctgtctctaccaaaaatataaaatattagccaggtatggtggtgcacacctgtggtcccagctacttgggaggctgaagtgggaggaccatttaagcccgggaggtgtaggttgcagtgagctgagattgtgccactgcactccagccagggtgaccaagtgagacttcatctcaaataaataaataaataaaatgagagaaaaaagaacaaacaaatactcttttcctccaagagggcactagaaagaggatacataatagtaacttttagaagagatttataaaaaatagagtgtgaattaattgtctctccccttggaaacaagagtttaacataaacaacatgggtttgcagatgtgtgtgggcaggatagggcaagaccaaggacagcatggtatcagtgaaggaaatgtgtaggagagtccagaaaacagcagccagttgagaagttcgaagcctgtcaaggaggatattttgatactatttacaaggtacttcacatacacgcatgatattttgtggcaggtaatagtaaggatgtaatattgatagaagagggagagctatgaaattgactatccccaagtagcaaacaagaattatagggtgaattatcctctcctatccctgagagaaagcaccagattgggcttctgtaaatgcaaaatacaggatgaaataaaggctcagtctgacagcggaagcttttggtttgttttctttggttgtccctcaaagtagaaagtaaagagaaggaggaagtagttcaaggtgcaaagatattctgaagtggagaaggaagaagtccacaggagtcatatgcagttaggtaatctggataagagcaaaagtaaactgaaatatgcagtagggtttgcatcatgggaacaaagaagattaatttgatgtgagtgatatgagctagggaaataatttaaaaattgaaaaaaatgtgaataataattgtagagattattccttttataaattgtgttaatacacacttcttttttaggggctagcatcacaaaattaccagaagcattgtgttgttttgccaattaaaggaatccaaataactccaaaatgattaattaccactttctgtaaatcctcaggtgaactcatttgcacagaattccctgcagttgtaaagaaaacagaacacttgacaacttgtcaggcacctacattcttttttccttttatttattaaattcttttactattacatgttattttccacagatgttatgtgaaatttctctcctaagcaaaataaataacttttttaagaattagaaaatctaaaggacaaaattttatattataaaactatacatagtattttattttgctggcataaatgcaaataatcatcttacagaaaaacattaatattacgttttgacttctttccacatgacatctacaaggcaaataacattacaaatcctcagtactttctaactgatatatggaaatagtgtggaaaatcacatgtagaattacatgtagtatgcttgtaatactgatttcctacaatgtacagatagggtaatactctgtccttggaactttgctgagaaagtatcaggaaacataacaggaaacatatcagaaacaactaaatggtgatttgtactaacattaatatattgtttatatataaataactctatacacatctctaagtataaatgcacacatctgtatgcatacatttattaacatccattgatataccacaaaaagtttgattaatcattttgagaaatacattaaaaaagaaacaaaatttttaatcttctccttactctatgacttccaatcttgggctcacattaacaccacttttttttgttgttgttgttgagacggagtctcactctgtcgcccaggctggagtgcagtggcgcgatctcggctcactgtaagctccgccccccaagttcacaccattctcctgcctcagcctcccgagtagctgggactacaggtgcccgccaccacgcccggctaattttttgtatttttagtagagatggggtttcaccgtgttagccaggatgatctccatctcttgacctcgtgatccacccgcctcggcctcccaaagagctaggattacaggtgtgagccaccgtgcccacccttaacaccactttttgaagatatctttaccttcaaggggtatttgtatcccaaatatattcagtccattgtctggcacatcatctgtcacatatagagctgcaagaagctcttccagtatcctagcatcaaaagaacattctcttcatgaccatttcactgcacctcagaaaaacaagaggccgaattcatcttcctagtcatgttgtggtgtaattaaatttaaaggaatcactacttatgtaatgtattttttccctttaagttgtctggagtaagttttggagaaacttgcatgataatatcaaaacttgttttcttattgtgttcagaaagcaaaagagaaatattaacattatttttagccttcttgtgttactggaaccatgtcacagaatgagagtttctctgggaataagatgtattgcaatattctgactaacagaatgtcagagtaagaaatttttatcagttgttctttgggtcattgtcacacatcatctgcatataatttccatagcagtgaacagtgaatgtgacattagcttcgcaatggtgttggcttgagggctggatataccgatgtgcattccagtcatggcaattcctggagaaaaaaaaattaattataatcattttgcataaatcaccatgaacaatgaggtactcatcaccttgtcagttagtttgcagcattcagttggctggcaaactggtgactttatgaagcattaaactatgtcaccgttagccagattaaactcactgtaacattatacttacataaagtgctttgtgaaggaaatatgaaaaatgttaactgaaccgatctcagaagacaggaaaatgattgtgatataatgcttgggttgaatattgtcactttcctggtgtaagcccattatggtttccaaaggactatattcaaataataagaaaaaagtcaggactctaacttggaagatgtaaagacatatatatattagatgaaatactctaaatgagaaagaaagaaaagaagaaaagggggctgtaaaatgactcaccatgtacagtctagaatcatagagacagggtgggagaggcccagagagagttgaagggtccagtatatttcacccctcagattctgtggattagaaaccaaagtctggagaaggttaagtgtctagcccaagacatagctagaaggtggtgggtccctaacctcgaatatagtatattttcacaggagcctaaatgaaatggaattcagggagtaagataaagaccagttttcattaacatttgcgttaaagttaaatatcatttttatgagaagacaaaagtaagatcaaatcctgaagtcaaagtaaataaccctgtgtaaaaacgcaaagttcatgggctttacaggctgtgctcacaagtctatgaccactgcttggaaggaacaggagtggaggctgtggcttattttcctggtggcatgtggtatgagccacaattttagtgaaagggtacagtcatgtcttaggtctctggaaactgcctaatgatttgatatcctggagattttttctggtctgctttatggaagacatttatatataggacagtgaaaaacactatttctggaggggaaagaacaatacggttaagtctaggttttctatttcttcttgagtttgttttcttttttgcttttagatttctaatcagctcaaaagatctccaagtctccaaacccttcacgaattaaaaaaaatgtaaaccctacaaatttcttaactccatctgcataacactgccacagatagaaaagtgtaaacaagataacaagagcatgggcaactctgtttttaaaaaagcaaaactgaattttattccagaagattctgtcctgtcctgtttgtaagctacgctgccaaaaatgagtgccaacactttgggagtggggagtgtatattgtttgaggtataaacatgattataatgtacaaaaataataatttacaaatgaaccacaatttctaaggttgcttcatatatgtcaattagtaaataaataaatgcataattaaaagaaaattgaagtaaaatagtcatttggtctcagcaagactctcaacaccagccaaagcatgaaggaagtaatgtccttttctctattcaagctgttacagctttctccagtggtcggaaacattttactcttcaccttctgataaaatcccagtcagctgcctttccctggtccgttcctccagcctcccatgaagaagtgatccttctcttttttaataccacttcttctcctctttatgtcttttgtcacatatcactgaaattttacccaaggactataccctctttctcctaaaagttccacctccctacttctatattctgatccattagttctcagtgtggtcctgggaacttgttaaacatgcaaattatctggccccactgcaaacctactgcatcacaaactctggggtacagtccagtattctgtgttttccccaccctctccaagtgactcagaaacaggctaacatttgggaaccacagctctaatatattctatcttaaagagaaaaaaaaaatggtactgcagccctgggtttcccttctactttccttcttccctgaactgtcaaattcctcagagtacttgttccctttcctttctcttattacatttgttttccaactcactggtcatactcagtgtcgtttggcattttgaggaattacatgttcggattgatttttgtgctgccaaataactacaatgctttctaaagttggaaatacagttgtgactagtggatgattagattcttctttgtagctctatttgactgtaatgggcgcaacttactggttttaccccagactagtccagaaaattatttagtgaacagaattgtatttttgcagtctaccaattatatcactagatatcttggaaaaaaacgccttgcaaagtagtgatagctggacaacctgggttgtgatcttggcttcttcattgtgtgacaataatataatacttaattattcttcacaataatattagtagttaattactcgttgctattagtaattattttgcttgctcacaaaattcaaggttattcatgtatttttctatctaaagcctcataaagcacagtgaagtatatttaatatcaattttcagataaataaatggaagtttagtgctattagggaacttgtccaagttaatgtagctaaaagtaggcaatgagctggatttccaaccaaggtctgtctaagcctgtcgaacaggctgctaatgaaaccttctgggaagttgttgtgtagattattctatttatgtattttattagttcattcaaaagcagtgttaagcctctgctttctggggtgcactaggctaagccctggaaacacagagaagaaagatacagcccacaaggaatcacattctggtgaaacaacagataactaaactatttaagtagatttttgtaagagtcatgatttagaggcacacagagcattgagggaacatggagactatatgaggtacataacctgggatggggagctcatggaagccctgctagggtcagtgaccttagtgttttgttagagaaacaagagccaggaaataaattgaatgaaaggaatgtaggaaaggaacctcagacataaagaataccagttgcaaagcaggagagagtaaataaataggcagaggtaagattacaaaaacttccatgcccttcaaaggaatcagaatgtctagaaggcaagaggaggagagtagggatacttttaagacaaaatgagagttagaaatctcataatgacaatactgtggaaagtggatttaagcattagaaggaatgaatgccaataattatcttagattgttttttttttcttctaaaaaaaagtggggggagatacatgtgcagaaggtgcaggtttgttacatagttatacatgtgccacggtggtttgctgtacctattgacccctcctctaagttccatcccctgaccccccaccccccaacaggccctggtgtgtgatgttcccctccgtgtgtccatgtgctctcattgttcaactcccacttatgagtgagaacatgcagtatttggtttttggttcctgtgttagtttgctgagaatgatggcttccagcttcatccatgtccctgcaaaggacatgatctcattcctttttatggccgcctagtattccatggtgtatatgtaccacattttctttatccagtctatcattgatgggcatttgggttggttccatgtcttttctgttgtaaatagtgctgcaataaatatacgtgggcatgtgtctttatagtagaatggtctctattcttttgggtatatacaaagtaatgggattgctggatcaaatggtatttctggttctagatccttgaggactactgtcttccaaatggttgaactaatttacactcccaccaacagtgtaaaagtgttcctatttctccacatcctctccagcatctattgtttcctgactttttaatattcgcccttctcactggaatgagatggtatctaattgtggttttgacttgcatttctctgatgatcagtgacgttgagctttttttcatatgtttgttggctgcataaatgtgtttgagaagtgtctgttcatatcctttgcccactttttgatggggttgtttgttttttctggtaaatttgtttaagttatttgtaaattctggatattagaactttgtcagatgggtagattgcaaaaattttctcccgttctgtaggttgcctgttcactttgatgatagtttcttttgctatgtggaagctctttagtttaatcagatcccatttgtcaattttggcttttgttgtaattgcttttggcatttttgtcatgaagtctttgcccatgcttatgtcctaaatggtattgcctaggttttcttcaagggtttttatggtttggggttttacatttaagtctttaatccatcttgagttaatttttgtataaggtgtaaggaagcagtccagtttcggttttctgcatacagctagccggttttcccattaccatttactgaataggagatcatttccccattgcttgtttttggcaggtttgtcaaagatcagatgattgtacatgtgtggtgtgatttctaaggtctctattctgctccattagtctatatgtctgttttggtaccagtaccatgctgttttggttactgtggtcttataggatagtttgaagttaggtagcgtgatgcctccagctttgttctttttgcttaggattgtcttggctctatggcgtcttctttgattccatatgaaatttaaaatagtttttttttctaattctgtgaagaatgtcactagtagtttcatgggagtatcattgaatctataaattactttgggcagtatggctaatttcacaatatttcctatccatgagcatggaatgtttttccatttgtttgtgtcctctcttattttcttgaaaagtggtttttagttctccttgaagaggtccttcatgtcccttgttaactatattcctaggtattttattctctttgtagtgattatgaatggagttcatgatttggctttctgcttgtctattgttggtgttaaggaatgcttgtggtttttgcacattgattttgtatcctgagacttggctgaagttgcttatcaatttaaggagtttttggtatgagatgatggggttttaagaggagccagctatctggattctagattttatgggctaaatggtgtctctcccaccacaacatttatattaaagggagcttggtactctaagccccagtaactcagaatttgactgtagtgagagatagattctttaaagaggtaattacgttaaaatgaggtcatatgaatatactgtaatacagtaaaactagagtccttataagaaggggaaattaggacacagacccatacagatgaaagaccatgtgaagacagggagaaggttaccatctaaaaggcaaggagagacagtagaagaaaccaaccctgctcacaccttggtcgcagacttctagcctcaaaaatcataagaaaataaatgtctatggtttaaatcacctgctgtggtgctttgttatggcagcccacaccaactaacacacaaaactgaaatttcatattttcattgatggctaccattttagatcagaatgacaactatatgctggacagattcttctgtagataacatcagacccacctagcaaatgtgtgctgaatttgctaaaagtaaaatattagctaggaatggaccatgttttcctttaatacttttgttaagacacaaacaccaaagactttccatttttgccactgtcttttctaaaggatgaattagtatgatataaagcatttgaagccttaagatgaaggaacactgcattaagttcaatgtaatcttcactttaaatctcttcttgagtgaagagtgcaaacatgcatccctgcctgaacacaaaggaataaaacctcgcctaagcactcctgacagtctttcatgcccacttgagaactggtcatctggaaccagccatccctacagctaccagaaaatacaacttcctctgtcactttcctgcagtatcacaaattacagaatggcacaagcgtgaaagagcaactactgaatgacgcgaaaaatatacagctaagagtgtgcaggcgagtgcaatggtgaggctcaaaagacttggtggagggtaaaacacagtgtgatcctcaagatttgccaccacagctgacttcctaattactactatactgctgttgaggcaggagaatagggtctggaggcagggaacctaaggctgatttacgcggacttctagaactaaatcaaaaggaaaaccccaactttccacacctaagtaacaaaaggactggaggatacgccctttgcaatcccccctccttttctgtgtggcagatagaaaattgaaagtatctctgattggttgctttctgcaaccaatcagatgattgcataggagtataactttgtaacttcacttcagcctctgattggttgctttccacaaccaatcagactagttgcacaggccactacttcatttacgtagggtatacaccaagtaaccaatggaaaaacctctagggggtatttaaaccccagtaaattctgtaaactggcccttgagtccctatgctcgggcctgcccccccgccccccgtggagtgtactttcgttttcgataaataatctgcttttgtcacttgattcttttcttgctctgtgtgtttcgtccagctctttgttcaaaacgccaagaacctgtacatcctccactggtaacactatctctgaataagataaggagtaatattagagctatcgttaataatataaataataggagatctctcttgccggaaaaaaggggaagcaataggcaagaaattagacaattcacccacatctacgctgctattaacaaaccaatgaacaggtttttctcagaagatggagaatatccagtaatactctgcgtgaattagaacatttggtgtgattaactgatttttgaagtgcacatattttgcctgactcttctaacttataaacaatgtctaaggatattaaaacattttcttcaatagctttatattggtttctaagatatctttatgaaaatatttgttttctaagatgttgaggtaattcagtattctttcagtaacttttgttttttctttaaaattgtccaaaaattttgagctctaaagtttaaaatatttgaagacttttgcagaaagtttttactaagacttaagcaaaagcgacttcagaaacttggtaatatggtattgcatgcctaaatacttgaaaaattcctatgattctttaaaaatactttttgaaagttcatgcctaaagacaaatgaaaaacttgattatttcaaaaacttattgataaatctattttactttaaaaatatctatttaaaacgtttatttataaaatggaatatataaaatgtgttaacactgcctaaagaaaagctttaagtaaaacttggctaaccaaaatgccagcatagttggtttccaatatcctttttttttttttttttttttgagacgaagtctcgtaggcccgggctagagtgcaatggtgtgatctcggctcaccacaacctctgccacccaggttccagcaattttcctgcctcagtctccagggtagctgagattacaggcacctgtcaccaggccaggctaatttttgtatttttagtagagacagggtttcaccgttttggtcaggctggtcttgaattcctgacctcaggcgatccacccacctcagcctcccagagtgctgggattacaggtgtgagccaccgcgccaggctggtttccaatattctttgttgaaattgtctgttgttgttatttggaaacaaagacaaattgcaatttgcggattttaccatcactgctgttttgttgtttaccaaacgaactttaaatttactttctggaagcttactcagatgcctcctaatcctgtacattttatacatttatagtaattttcagtgatagtttgtcatatgaataatgaacctaaaaccctgaatcatttgtatttatcaaggaaagactactataaattcattgaaatgtctttattacaacaagaaactgcaacaacaaacttttgaaagatttataggaagaaggaatgggtgattgtggataccagagctgagccagaatttaacaagaaagagcaatggcctggaatattgccctctaactagctaatcaaaggacttttttttttttttttttttttttgagacagaatgatgctctgtcacccaggctggagtgcaatggcgtggtctcagctcactgcaaccttcgcctcctgggttcaagcaattctcctgtctcagcctcccgtgtagctgggactacaggcgcacaccgtcatggctggctaattttttgtattttattagagatggagtttcactgcattgcccaggctggtcttgaaccactgagctcaggtaatgcacccgccttggcctcccaaagtgctgggattacaggcgtgagccaccgcgcccggccctaatcaagatcttagcatcatagcatgagttaagggcaaatacaggttctcctcacagtctaagggctattaattgaataattaatagtattaaaatttcacagcaagatgccctatgaaaataaattcaacttaagtgatagatattaagaaatgcaaaactttcattttcagataatatactatgaaagctaaaacagtatactacgtttcaaactcatttagtaattattcaaacatataacaatctcctgctggtttttaaatggatgttttacattatgtgccttctcttcaaatgtggccttttctaagttttgattgaatagaatgggtttttttttttcaagatcaagtctttttgtagggcttgttgttgttttttattgctagctaagtggttccttggagattgtggatgaatattgagattctttagagaaatgaagttcgtctgttacaattacactggcatgcttccttgagaaaagcagaggatatacagaaacatctaggaaagcctgtacatttttgagaagttagaaaattagttcccgattttcttttcttttgaaaaaaaaaaattttgtttcattatctcaagaaatgtggaattagctagagagggttgtcttatttttaatttgaaggagtggattcaagtgagaattaatataaacacatgctaatagggctgctttatgcttatgaggggcaagttcttcaccttcagccacactcaggcacaaccatgaagtgggttgagttggctctcagatcctcagccagtttccccctccccctccccctcctcctttctcaccacttgctgtaccctgttttcttccctctggcacctggtgttctctttacccactgctgcttctcccctgttgctccagagacaaccagtgctcaagaaaaaaaaatagtaaatgacttccatgaaagcatcttgaaactccggtttagacagagtaatgccaagacttgtgagagggctgagatttcactctgcttacaaaccaacaagcttgctaactcctgcaacagctccacggatgctggcagaagacatggcttctgggtctgggatgaaggacagcttattgctcgtagcaatagtggacagaatatcaacattttcatggattccctgagccctaattcagagggtctgcatacagcagggtggatttcaggagagaggtctcaagcttaggaaaccacaatcctttaaaaaggactgcaaccaaagctgcccaacatacaccccagagggacattatctttgttctagtggacagcaaatacaccttcattctgcacaggcagacgccaccatttctaccttccaaagtggttcactataaaaagttttttagaaaatgtccagaacaaaagatgattagtgtctctgctcacaagggcagaaaagcaacagactcatggagaagtctctcccaacatgcatatgttctgtgtatgcaggagggaggaattcatgggtgtaaagttaaaatagggcattctataaagcctacccaataaaataatgtaatcttacatttgtatggagaagagaaagtcttcgttgtttttgtctgcttgtttttgtaagatgaactataaaacataaagctcaaaaaatgcatggttgagatgtgtatgtaattgaagtattttcaactgagggtcatgttagtgttttaatattggcatattttagaagagtgaagatggatttaaaaggtagagaaacactggcttaatcaccgattatccacagggatgtttacattcagtggaggctaaagcctaattctaacatgatttcagtcatcggccaggatgtggggcagtgttttgagggtcagagagaggccttttcacagaaattactccaaaagaatggaggcctactctatatctaaaacattgtctgaataatgaacacaataattaatttgcttacattccttttaggaaatactgaacaatttctttgaattccttcagggatcttcgatatttattatacacatttcagtaaagaatgttaaaataagtatccctgtcccaaacacccagtctgtttctggtattttgaaggcgtgaatgtctcattaaccgagacaatgggaatgatgctaagaaaagctcttttttatttaactctcatgctcagtttatttttattctcatagttattatattctttagaaatattatatcctggtttctgcagttacactacttaagcaatgtcagtaacacagtcttctgcatagctccttgttagaaaaaagcttccctaatgcacagacataggagagggagaatcaaacagtaacacctcttgacatcctcaccagcactgtcactgggaactaattggaagataaactcggagaagcttattaaccctcctaatgtggataggaattggataggggcagggtgatagaaatcagtgcagggcaaaatgtgggtgtccctttcactttcacagttcagtaagatataaatactgtgtcatttttgttttcttgtttgctttttatttttagagatagagggagaaataatctagcattgtacattaaagtaatacattagaaaaggaggaaaactaatacaatatttttcctgtagcaaaaccccagaaatgcaaaaagacaagcaaaaagcaaggacttgagcttacacaatagaacgaatgtcctttacataaaatgttagcatatctgtaccaataaactaatttctaaccataaatatttgcattacgagaataaagatgaaaataaaccaatactttattaaatgggggtaagaaaattctcaagatagaatgaaagaaaaaatagtaaagataaaagtaggaattaatgaaaaagaataaaaattaattctcataaaagacagttgccaaaataataaaatagtctaacatccaaaatcgggctagcctgatttaaaaaaaaaaaagaaatctaaatgctccaaaatagtgatggaactacaacatgcaatctgaaacagtagagaaaatgaagacacaatttaaagcatgagaaaatgaaaataaatggtaaaaagtatcatgcacaatgagattatgcatgattcttttacaaatctgaaaatgtgtgaaacaagttattctgaagggaatataggttgccaaaataaaataaaaaaacatttatagatgaagaaaggtacagtatcaaactgtccattaaccattgatcaaaaattaatgtcctctaagagatattaggagaggccccaagaatgatagactggagtaggaaaatgtggcacatatacaccatggaatacagccataaaaaaacggatgagttcacatcctttgcagggacatggatgaagctggaaaccatcattctaagcaaactgtcccaaggacagaaaaccaaacaccgcatgttctcactcataggtgggagttgaacaatgagaacacatggacacagggcagggaacataacacaccagggcctgtaggggggtagggggctggggtagtgatagcattaggagaaatacctaaagtataattaaaaaaaaatatatatatatatagtcaatctttcaaggaatagatcaatattgttatggacacatttccagactgtagagaaatatgaacaactcttatgttcaaatattccataagtctgattcttacacatgataaaatctgtctaccacaggaaaaaaaaaagcttcaagccaaactcatttttgattatagatgctaagattgaaataaagaaaaagtaagttacattgagctgtatagacatataaaatagcactttaatacattaataggtaaacttagtttgcaaaattatttacattgacacaaaaagttatttgataaattcaatactcatttctgattaaaattttttgtaactgaggggggaacacttatttcatttaatttaatattttaatttattttgggatggagtctcactctgttgccctggctggagtgcaatggtgtgatcttggctcactgcaaactcggcctcccaggttcaagcaattctccccagtagctgggattacaggtacccaccaccatgcccagctaattttcgtatttttagtagagatagtgtttcatcatgttggccaggctggtctcgaactcctgacctcaggtgatccgcccgcctcggccttccaaagtgctgggattacaggcatgagccaccacgcccaggctcttaattttaattttaattgtctaatgacagaaaccatgagaatagtccagaaatacttcttagaataacactttaatacacatagattcttgatataatttaaaactatattattaaagtaaataccttccaatgtttgcttttgcattaatattaccatgggtatcaagatagtactattgaaacaaaaacagaaaaaaatataaaacagaattcaaatttgcaaatgatatggaagctgaactatgtatacctgacactgatagttgcaatgctgtatcaagagtttccctgataagctctactactaattgtaccagctagaataaaaagcaacaatagattataatagcaaaatgtaagaaattagatctgataattaacgtagtagggaggggatgtgaagatatgttgtttagaataacttagtttttctgaaggacgtaagatagcttagaaaattaaaaagaaaggttgtgtcataagagtgtgtaatgtaaagctcttaactttccacaaagtaattattatgtttaattatattataataaaaatttcaaaaagactttttgaagacaaattgattctatagttaatctagaagaataataggatgatatagattattctgaaagaaaataagagagcagcttatgccaatatatatgaaaaaatatatgcatatagaataaatgtaatagtaaggaattgaaacaaaaatagaatagcatcaatcaataaaatagagtccaaaagtatgtataaaaatgttgcatttaaattgaagatgaaattaattatttaatacataatcctggaagatgtgtttcacaatgaaggggaaggtaaatttagattatttgctcaattttccaaagtacttagcaaatagattaaatgtgtgtctataaataaactggaaaataaacttatcttaataagcatttgttgggtctcaagatgaggaacaccatgctatatgaaacagtgaaatccatagtaaactccatgaaaggagcaattaaacacaaaatcaatttttaaaaaaatatttaaaaaccacaaatcagtgtttctcaatttgggtttctaggtacctagtgttgatgatttatatttatgattttataggtaatgtaatgtatcaatattgcttcattaattttaacaaatgtaccacgctaatgtaatgaataaatattaggggaaactgggtgcagagtatatgtaaatctaaaactctcttaaaataactcattttaaaaaatggaaaatgttaatactaagcaattcagaaaatctattacaagtaatagaaattgctaaggtaagaaaatatcattaatctcttcagcatgaaacaaatgtaccaataagttgccttgtttaacatattaaagtaataaatgggtggatttatatctgggtgctctattctgttccattggtctctgtgtctgtttttgtgccagtaccatgctgttttagttactatagctttgtagtacactatgaagttcaatatgaattcaggtaatgtgatgcctccagctttgctatatatatttcaggaccttttgtggtacaaaagtttttgggttacatgaatgaattggatagtgatagtctgatattttagttctcccatcaccagagtagtgtacatcgtattcaatatgtagttttctatctctcattccccccgccaccctccctccttctaagtctccagtgtgcattataccactctatgtctttgagtgcccatcaactttgttctttttgctcagggttgctttggctattctgggtattttgtggttccatatacactttaagattattttttctatttctgtgaagaatgttattggtactttgaaacggattgcattagatctgtagattgctttgagtatggatattttaacaatttgattctttcaatctaaaaacatggaatatctttacatttttgtgtcctcttcaatttctaatataatattattcaactatgaaaaagaataaaatcctgtcatttttaacaaagtggatgggaagtggtgaacattatgttaagtaaaataaggcagacagaaaaagataaagtagcatgttctcactcttatgtgggagctaaaaaaaataaaattttaaaaaaaaaaaggaactcagggtgatagtaagatgatacttaccagcagctgggaagggaaagaggagaaggtgattaagaagagttgcttaatgagtcaaacatacagttagaaggaataaaaactagtgtttggtagcacaataggttgactatagtccacaattaatttattgcatatttcaaagtacctaaaagagtggaactggaaagttcctaaaacaaagaaataataaatgcttgacatgatggatatccctattaccctgatttaatcattacacattatatacttacatcaaaatttcacatttaccccataaatatgtacaactattatgtatcagtaattaaatatttgaaaatgttcaaggaagcatgcttataattatcctttaaatctgtatatgtaaactcttcataataaagactaatgtagaaaaaaaagaaacgtaaaaacttcttctcaactcatgcttacaagcttctttgttaaacacttccattcactgaaagaaacaacacataaagcaactttaaagaagtatgcttagatttactttttaaacctgtataaaaaaaaaaaaaaagtaggaccaggcacagtggctcacacctgtaatcccagcactttgggaggctgaggcaggcggatcacttgaggtcaggagttcaagaccagcctgggcaacattgtgaaacccaatctactaaaaatacaaaatttagccaggcatggtggtgtatgcctgtaatcccagctactcaggtggctgaggcacgagaatcacttgaacctgggcagcggaggttgcagtgagtcgagatcgtgacactgcactccagcctgggttctctatctccaatgaataaataaaataaaataaaataaattagcagaggcttttaaacacctacattacacagtggcattaatgtagggaaggttacttttatatattatagtgttaataaagtatcacacattttctgaaagcctctttggcaatatatatcagaaaccttaaaaagattcctattttttgactcactcatttttgtaatctacctcattaaaacaatcataaaaacaaaacaggacttaacttagatggttttatttatgactatttattttgcttcggattttctcagaagaccacaaacccctctagatattttaaatagaatgagatacaatacagagaatcagaagcttacaaaatcatcagaactactggtggagcaaaggtgacggaaattactgctcatttcagtaaatcagaaactggggaagttacagaaaactgttactgatctcatatttgcaccaaggaagtgagttaatacacctgcccactgcagtccctagagcaatagtgacttccttcactccaccttcaaaattctgctgaaatgcctctcgttggcagaatttaatgtgaaaaactgttgtcaggaactctggaaaacatagttctctggctcccagccttttaataaagaggaaaatataaatgtgtatggggaagtggtggtagtggcactgtactgttaacaaaaaatgcaagaatggaaaaaataagtcagcaatttaaatgccaatactcttcagtggggaatagtttactacattggagtattcatttgatgagattgtatgcagtcattaaatatcctattctgcaatacatgataaatcatgtatcattatgttttaataaaatgagaacatttttactattaattggatgaaaatgtagttcataaagcagtagagtacaaacctactttattatataatatagcatcattctattcaagttcaactttatagtaaaactaaagattttctaaatccaaaattcaattttctagacatagttctaaaattccatttttaaaagtctatggaaagaaaatgaagttctgttaaggtatatgtagaatacctggaaaacaaagttctataagtttttttagcttaatgtaacattaagagcccataatctaaaatattacattgtccagtgatattgtcatgtattctagttgtagttacttttaaaataaatgctaagttggaaaagaaagcacattttttatggctaggttttgtaataaccaggtgactattctaaagatctcattcacttataaaccataaaattaaaaaatgttttctcaatggccataatagtggagaaataggttgcttttctccagacatagtgctttgagtctgtacttcatgaaatatcatctgtaatcatctttgtacttacgaaattatcaagatgtaattatcaagatggacactatgggctattgttggatgaacacgccttgacaaacagtcaatactttaaaacaaaacaagcagtacatgaacatattcctttcctttgcagagagtttataccctatttctaattgttgtttgagaaggtattttaatagaatggagttatttactctagaggcacactctggggggtctgcataggaatgtgagtcccaggtgttttccaggtctctctctccttactaatattactcagccactctgtcttctattagttctgttttgcctcaggtttcctaaattgtcaatattttgttttgatttaatgtctagaaagaattccaggatatatttttatactaacttttgttcaaaatgcaattatctctctttatcctcacttcagcttccataagagcatttaaaggtcagggaagagtttttaagcagatcagtttggagaagcagaaaatctctatggaaaagtgcagggtctagtaggaaagaccatgtagaaatcactatatattgttttatttactgtcccctatgactatctgaaagacctagcttaatgaagattgaataaaagcattaaaaagtaatgaagccatataaattctgggcttgggtttaaaaattataattctaaccattttataatagttgttaagatacactcacctatgcacacatatattcagaaatgtttctaatatatgcaagtagtactgtgtgtatgattatgaagggcataatcaatgtaattcaaaaaacaataatgtaatttgattataagaatattaggatttgaaaaataatagtcatattcttgctaaatgaacaattcaaattagtcacattaaagaaaataataaactttaatctgtgaaacccattattaagaaacttcatttaatggattaatctcattgcaaattgcatagtgctatacaaaaaatgattactaaattgaaaagtttccccttatgtacaagttagatatataatctgtttgtttttatgtatattgtgtttaaaatcctcatattgctcaggattaccttggttatccggggtcctttatggttccctattaattttagaattgttttctaattctgtgaaaaatgatattgctagattgataagaatagcattgaatttgcagattgctttgggcaatatgagtatttggccacttaaacaatattaattcttctaattcatgagcaaggaatgtttttctatttgcttgtgtcatctgtgatttctgtcagcagtgttttgtccttctcctggtagagatctttcacttccttggttacatgtattcctaggtatcttgtgtgggtgtggatattgtaaatgaggccatttccttgatttggctctgagcttgaacacttttgctatatagaaatgctactgattttttaaattgattttataccctgaaactttatcgaattagttatctgttctaggagactttaggcagagtcctcaaggcttttatagaatcagatcatcagtgaagagagatcatttgatttcttttctgattttcaatgccttttatttcattctcttgcttgattgctctggctagtacttccagtactatattatataggaatggtgaaagtgggcatcctctgcttgtttcagttctcaagaggaatgctttcaactttttcccatgcagtatgatgttggctgtgggttgtcatagatggatcttactattttgaggtatgttcctttgatgcctagtatgttgagggtttctatcatgaagggatgttgaattttattataaactttttctgcatctgttgagatgatcacacactttttgcttttaattctgtttatgtggtgaatcacatttatcgacttgtgtatgttgaaccagccttgcatttcaggaataaagcctgcttgattgtggtgcattaactttttgatgtgctgctggagtcacaaaatactaatttgctagtattttcttaaggatttttgcatctttgttcatcagggatactgacttgaagttttctttttcattgtgtcttttccaggtttgggtattaggatgatgctagctttgtacagtgagttagggtggaacccctcctccttggttttttggaatcgtttgaggagaattgctaccaggtctttttttggatgtctggtagaattcagctgttaatccatctgattcagggcttttattggttagtaggctttttattaatgattcagtttcagaatttgatattggtttgttaagggtttcagttccttcctaattcaatcttgggagattgtatgttttcaggaatttatccatttcctttagacattctgttttgtgtgcatggagtgtttacaacagtctgtgaggatcttttgtgtttctgagggattggttgtaatgtcacctttgtcattttttaatatgcttatttaaatcttctctcagattttcatttgttaatctagttattggtctattgatcttatttatactttaatatagccaacttaatttcattgattctttgtaatggtttttggcttcaattttgttcagttctcagattttagttctttcttttcttctgctggctttaggcttagtttgctcttgtttttctcctttctctaagtgtgatgttagatcattaatttgagatatttctaattttttgaggtaagttttagcactataaagtttcctcttcacactgctcttgctggatgttgtatctctgttttcatttattttttaaaaatgtattaatttctgccttaattttcctgttcattcaaaagtcattcagaaacaagtcatttaatttccatgtaatcatgtagttttgagggattttctttgtattgatttctatttatattccactgtgatctgagagagtatgcttcgtatgatttagatttttttgtatttattgagacttgctttatggctgaacatgtggtcagtcttggagtaggtttttttttttatttattgagacttgctttatggctgaacatgtggtcagtcttggagtaggttttatgtgcagatgataatgtattgtatagttgataggtgatgtattctgtatgtgtctactaggtccaattagtcaaatgtcaaatttaagtctagaatttcttagttttattccctgatgatctgtctaatgctgtcagtggggtgtttaagtgccttattattattgtgtggctgtctagttcttttcataggtctagaagtacttgttttatgaatctgggtactccaaggttgggttcatatatgtttatgacagttacgtcttctcattgaattgaactctttatcattatgtaatgctcttctttgccatagctcaacatcaaactatactataaagctaaagtaaccaaaacagcatagcactggcacaaaaacaggcacatagaccaatagaagagaacagataacccagaaataaagccacacacctccaataatatggtctttgacaagtcaccaaaaaattaggaatggagaaacaactccctattcaacacacggtgctgggatagactaaccgtatgagaaactagacctctgcctttcaccatatacaaaagttaactaaagatagattaaaggtttaaatgtaagacctcaaactataagaatcctagaagaagacctaagaaacaacattctggactccagccttgggaaaaaaattataactaagtcctcaaacacaattgcaacaaaaacaaaaattgacaggtgggatccaattaaactaaagaaaatgtgtacagcaaaagaaactgttaacaaagtaaacacaacctacaaaatgggagacaatatttgcaaactatgcatcctaaaaacaaccccattaaaaagtggacaaaagacatgaacagatgctgatcaaaataagatacacaagcagctaacaaatgtgtgcaaaaattctcgacatcactaatcatcagagaaatgcaaatcaaaactgcaatgagatatcatctcacacaagtcagaatggctaatattaaaaagtcataaaacaacacatactggtgaggctgcagagaaaagggaatgcttacatgctgttggtaggaatataaattagcccatccaccatggaaagcagtttggagatttctcaaagaacttagaattgttatccagcacaacaatcccattactggatatatatccaaaagaaaacatatcattttaccaaaagatacatgcactcatatgttcagcatagcattgttcaaaatagcaatggcatggaatcaacctaggtacccatcaatggtgcattggataaagtatggtacatgtacaccatgtaatactgtgcagccattaaataaatgaagtcatgtactttgctacaacatggatgcagctgaaggcctctattctaactagattaacacagaacagaaaaccaaataccctatgttcacaattataagtgagagctaaacattggtactcattgacaaaaagatggcaacagtagacactggggacaatcagagtgaagaggtagggatgtggagaagtgttgaaaagctgcctattcagtattatgcccacaacccaggtgatgggatcagttgtatcccaaacctcagcatcacaaatatacccatacaacacacttgaacatgttcccctgaatctaaaattaaagttgaaattattaaaaacaaaattgtattcttgcattaaaaatgagtacaacaaatttaaatggattgtgtgtagtttaaatattaacagttcttaaatagaaaaatgaaatgtgaacactaagagttaacttacactaaaatatattctcaaattcctggtgtgtttttaagtgaagtttccctaacatcaggatgttaaattaataatctctgagacatttaaattttgttatccagtatattagtcagtattctccagagaaacataaccaacagaatgggatatatatacacacacactcacacacatgcatggtgatttattgtaggaatttgttcatgcaataatggatactgataagtcccacaatccgctctctacaaattgaaaaatgagaaaagctattgctgtaattcagtgtgaatctgaagacctaagaatcagggaaggcaatttctgagggcggaagaggagggatgtcccaactcaaacagaagcaaattcaccctctcttcgtctctttgttctatccaaaccctcaatggattaaataatgtctatccacattggtgagggccatcttctttactcagtttgctgattcaaataataatctcttccagaaacattgtcacaggcacacccaaaaataatattttaacctcactttaggcatctcttagcccagttgagttgacacatcaaactaaccataacaccaaggaaatcatgttagtattattgcaaagatatccacaatgcatttttctcacaaatgccctttttcctgtaaattgtatcacttcatctcttaaatgccctcatcgcaaaaaaaaaaataacattgtattggtcagtgttcttcagagagatagaatcaaaaagatatatgtgaatacagatattttaaagagatttattagggatactagctcacatggttatggaggcaaagtcccgtgataggttgtctgcaggctggaaaccctgagatgctggcagcatgactcagtttaagtccaaagccccaggaactagggaaacctatgacataactctcagtctgagtctgaaggcctgagaactcagggggccactggtgtaaatcctggagtgtctgtgtagaagatcctagatttctgatgtcccaggacaggagaagagtatatcccagctccaagagaaagagggcatcacctttttgtgcttatcctcgtcctcagatgattgaatggtgcccagacacactgagggcagatcttccccacttagtccaccaactcacctgccaatctcctctggaagcaccttcacagaaaaacccagaaataatcccttaccggttctcttggtaattcttaatccagtcaagtcaacacctaaaattaaccatcagaaacatataactttgaacaatttgcgtttacctttacccactcacataaaaacaccatacgtaggagttcaaaggaatttaaattgtttgcaatttttttcttttataactaggaatgttagcaaaacaccatacggtgagacagcaaagcacagtggcttaggagcacagactccaggttcacactgcataagtttgatcctagctctgttatttaataatataggacactggctaagttatttaacctctctgccttggtttgctcctttgtaaaatggagataataaatattttctaccttatatgattggtatgatgattaaatttacttatgtatgttaataagtatattgaacaatggcctgtaagtacttaatgattaattgaaattattatatctcttattaaagatggtttgcttatatctcatatagccataagagatattttgtgattgggatcaggaaaacaggttatatcaaaggcaggtagtcacctgtttctctttgcaatatttttaaagatttgatacttttagaacagttttagttcaaagcaaatttgaaaggaaggtacagagatatcctgtatatttcctgcccccacacatgcatagcctcctccattatcaacatccttgtattagtccattttcacactgctatgaagaactacttgagactgggtaatttataaaggaaagaggtttagttgactcacagttccacatggccggggaggcctcagcatacttacggtcatgatagaaggtgagggggaatcaagcaccttcctcacaaggcagcaggagacagagagagcgagcaaagaaggaaaccaccagacacttttaaacaatcagatcttgtgagaattccctcactatcatgaggacagcatgggggaaactacccccatgatccaatcacctcccaccaagtccctgcctcaacatgtgaggattataatttgagataagatttgggtggggacccagagcaaattatatcaatgaagtgtggtaaattggttacaattgatgagcctatactgaaacatgattatcacccaaagtccatagttcacattaagatttattttgtattgaacatcctatgggttttgacaaatatataatgaaatatagccaacactatagtagcatacagagtgttttcactaccccaaaaatctgccatgctgtatctattcatccctcactccccacaacctctggcaacaattgaactctgtttttctccatagtttagccttgtccatagtgtcacatggttggactcatacagtatgtagccttttcatattggcatctttcacttagtaatatgtgtttaaccttatgtcttttcatggcatttttttcagtgctgaataatattctattttctggtctgtttgtagcacagttcatttatccattcacctactgcaagaaatcttcattgcttccaagttttgacaattatgaataaagctgcttataaacattcttgttcaggtttatgtgtgaacatatgttttcaactcttttgggtaaataccaagaagtgagattgctggatcataccataagagtatgtttaattttaggagaaactgccaaactgtctttcaaagtggccggaccattttgtattttcactggtaataaatgagagttcctgttgttttgcatcctggccaatatttggtttttaaagtgttctggattttggccattttaggtatgtaatgatatctcattgttgttttaatttgtagttccctgatgacatatgatgtagaacatctttttatatgcttatttgccatctgtaaatattttttgagatgtctgttaagggttttggtccattttagttaagtaatttgttttcttattgatgagtgttaaaagtttcttttatgttttgaaaaacagtagtttatctggtatgtgttttgcaagtattagttcccagtctgtgttttttttttcatcttctttatagtcttttggcaaagcagaaatttttagttttaatgcagtctagttcaccaactgtttctttcatgaatagtgccttgggtgtcatatctaaaaattattgccaaacctaaggtcatgcagattttctcatgtgttaatttctaggagctttctagctttgtatattacctttaggtctgtgatccactttgagttaatttttgtgaaggatataaggtctatgtagaggttcactattttctgtgtggatgtccagtagtaaagcatcatttgttaagactttctttgctccatcgtatagcctttgcttctttgtcaaagatgattgtgggtctatttctagactctctgttatgttccatttatctatttgcctattccttcaccaacactaaacactaaacttatttacagtcttatttactgtagcttcacagtaaatctgaaagtcagataatatcaaagcttcaactttgttcttctccttcaacattttgttaaatgttctgggtcttttgcatccccatataaactctagaatcagtttgtcaatttctacaacataatttgctggggttttgtttgggatggtattgaatctatagattaagttggaaaaagctgacatcttaacaatattgagtcatcctttccttgaacatacattatctatccatctatttagtttgtccttgatttctttcatcagaattttgtagtttacctcatattaattttgtaattctgatggatttttcataagcatttcatttttggagatgctaatgtaaatggaagtatgttcttaatttcaaattctacttgttcattgctggtatatagaaaagcatttgactttttcttattaacctcatattctgcaactatgctataattattaattccaggaggatttttgttgttgttgattttaaaaaaattctacatagactatcatgtcatcagaaaaaacatgatttcttccttttttctttttctttcttgctgcattagataggactctcagtacaatggcgaaaataagtggtaagaggagacatccttgcctgttcttgatcttagagggaaagcttctagtttcttaccattaagtatgatgttggctgtagattttttgtagatattctttttcatgttgaggaagtttccccttattcctaggttactgattgtttttatcataaatgggtgatagattttttttcagataatttctctgcatttattaatatacttatgtgattttttaaatttagtttgttgatgtgatggattacattaattgatttttaaatattgaaccagtcttgtatacctgagataaatctaagtaggtcatgttgtataattctttttgtatatatttggattcaatttgctaatattttgttgaggatatttgtatctatatttataggaggtattggtcatagttttcttctactgtctctgtctaggtttgttgctaagatgaggctagcctcatagaatgaggtagaaagtttttcctcagcttctatcttttgaaagtaattgtagagaattggtataatttattctttaaaagtttggtggaattaccagcgaacacttacggacctgatgctttctgttttggaaagattattaataattgctttaatttattaaatacatatagacctattcaaattctctatttttgcttttattagatagattttattttctttcaaggaattggttaatttcatctaggttatcaaagttttggacatagacttgttcataatattcgttatcttttaaatgtccatgagatctatagtaatggcccacctttaatttctaatattagtaatttacatcctctcttctttttagttagcctagctagaggcttattgattcaatttatcttttcaaagaaacagcctttggtttccttgacttttccctattgatttcttattttcaattgcattggtttcttctccatgttttattatttattttcttcttcttactttgagtttaattggctcttctttttctcatttcctaatttagaagcttagataaatgactttagatatttcttttctaacagatgctttcaatactgtaaatgtccctcaaagcattgtttttactacatccaacaaatgttaataaattatatttttatttttatttacttaaaaatatgaatatttctcttgaaatttttcattttacccatgtgttatttagaagtgtgttcattgtttaatctccatgtattttaatctccaaaatatttaaaaatatttttaaatttctcttgaaatttcccactttatccatgtgttatttagaatggttttcattgcttaatctccatgtattttaggatcttccagctatttttttctgttttttttttcttgtttaatttcattccggactataaagtaatttcaaatttgtcaaggtgtgttttattgcctagaatatgatgtgtcttattgaatatttcctgtgagcttgagaagaatgtgtattctgttgttggataaagtagtctgtagatattcattatatccagttgattcatgatattgctaagttcaactatgtttttactgattttctgcctgccatggtcatctatttctgatagaggggtgttaaagtctccaactataatggtggatttatctatttctcttgcaattctatcagtttttgcctcacatactttgctgctctcttgttaggcacatacatgttaagaattcttattatcatagttcattttgagctgctataacaataccacagactaatttataataaacagaaatgtattggctcatagttctagaggttgggaagtccaagatggagaggctggcttcctgcaaaagctttcttgctgcattatccaatggcagaaaggcaaagagagggtgagagagcaagaaggggctgaacccattcttttataatgaacccattttcacagtaatgaactcactccctgtattagtcagggttctttaaagggacagaactaataggctatatgtatatatgaaggggagtttattaggataattgactcacaggatcacaaggtgaggtcccacaataggccatctgcaagctgaggagcaaggaagctagttggagtcccaaaacctcaaaagcagggaagccgacagtgcagccttcaatctatagcagaagacccaagagcccctggtaaatcactggtctaagtccaagagtccaaaagctgaagaacttggagtctgatgttccgagggcaagaagcatccagcatgggacaaagatgaaggccagaagactaagcacacctcttcattccactttcttttgcctgctttattctagccacactggtagctgattaaatggtgcctacccagattgaaggtgggtctgcctctctcagtctagattcaaatgttaatctcctttggcaaaaccctcacagacatacctatgtacaacattttgcatcctttaatccaatgaagttgacattcaatattaaccatcacatttacataataatggcattaatccactcatgagagcaaagccctcctggcttcatcactttttttgttgttgttgagacggactctctgtcgcccaggctggagtgcagtggcgccatctcggctcactgcaagctccgcctcccgggttcacgccatgcttctgcctcagcctcccaagtagctgggactacaggcacccaccaccacgcccagctaattttttttttttttttttttgtatttttagtggagacgggttttcaccgtgttagccaggatggtctctatctcctgagctcgtgatctgcctgcctctgcctcccaaagtgctgggattacaggcgtgaaccaccacacccggcaggctgcatcacttcttaaaggtcctgcctctcaacactattgcactggggattaagttttcaacacatacttttggagggacaaattcaaaccacagcagttatggccaataattttctcctttatcaatatgagattttcctctttattcccaatatattttattgctttgaaacctactctgtctgaaattagtatagctactcttgctttcttttgattagtgttaacaaggtacttctttctccatccgtttacttttaatctacacgtgtctttatatttaaactgagtttctcatagacaacacagagttgagtcttatttcttgattcattctgacaatctctatcttttaattagtgcatttagacaattgatgttcaaaactgattattgatatagttgtaataatatctaccagcataccaactataccaattgatatagttgaagaattaatagtgatataattggattaatatttagtactgctttgtatttgttgcctttctttgttcctatttttgtcttccagtcttttttctgccttttgtagtttcaattgagcattttgtatgattacgtgttctctcctcacttagcatacaaattacacttctttttttttatttttattttttgagatggagtctcactctcttgcccaggctggagtgtagtggcatgatctcggctctctcaacctccacctcccaagttccagtgattctcctgcctcagcctcccgagtagctgggattataggcattcatcaccatgtctgactaatttttgtgttttttagttgagatggggttttgccatgttggccaggatggtctcaaactcctgatctgtgatctgcctgcctcctcctcccaaagtgctgggattacaggcgtgatccaccacacctggccacacttctttttaatactttttttttaaattgttgtcctggagttgcaatatgcatttatatataatccaagcccactttcaagtaacaatataccacttcatgggtagtgtgagtaacttataataaaaaaaaactcttaatttcttcctcccatcccttgtatcattaatgtcattcattttacttatatgtaagtatacacacacatacacaatatatacattaagtatacataattaaatacatttttcatggtatttttttgaacaaatatttacttgttaaatcaattaagaataagtaaactagagcatgggaaagctcagaaaccaacacaagatcccagaaaatggggccaggcatgcagggaaactgagcagccagcaatacctgtcaatgtcatgttccttgatatgcagcagtgatgctgggctgcagctgagagtgccgtcccattgcaaggaatatcaggtccatgcttctgctgtctcaggtgcccaagcttagcatgggttctctcagctcaagccaccagccctccctaggacccgagaaggtgaagcccttgtgtgaagtcctggctcttgtcaaggcagggtgctaaagaagaaacagaaaagaagttaagaaaaaattttaattttatctttacttacttcttctttgatgctcttccattctttgcatacatttgagattttgacctatatcattttccttgtctccaaatgacttaggatgttttgcaaagcaggtctactgacaagtccccttaatttttttctttggccagacaaagtctccatgtctccttaaccattgaaagatagtttcacaaggtacaggattctaggtttgtgggctttttctctctcaacactaaataattcactctactcttttcttgcttgcatggtttctgagaagaagtcagatgtaatttttgttgttgctgttcctctgtaggtaaggtgtcacccaccccctctctggcttctttcaggattttttctttacctttaattttatataatttgaaaattgtgtgcctacatacagttttttgacacttatccttctttatgttctctgaggtttctggatacatggtttcatgtcagacattaatttgagaaagttctcagtcattcttgtttgaaatatttatttggttcatctgtctcttctctttcttgtattcctattacactttcgtagtttccccacagttgttgtatattctgttatagttttttttttcagtttttattctttatgcttttcaattttggaggtttctattgagataccatccagctcagagaatttttcctggaccatattcagtatactgttaaccacatcaaagttacttttatttctgttacagtgttttttagctctagcatttctctttagctcttaagatttccatctctctgcttactttacctatctgttcatgcatgctgtcacctttatccatttagagcccttagcatattatcataattgttttaaattccgtgtctgataatccaatatccctgccatgtctatctgtgaggcttgctttggcccttcaaactgttttttgtctttttgtatgctttgtaattttttttctttatagccagacacaatgtactgggcaaaagggagcactttaaacaggcctttagtaatgtggtggtaaggtatatggggagggaatatgttctacagtactctgattaggtctcagtctcttagtacccctatgcctttggactgtgaacatcacaagtgtttctcagggttttttttttttttttttttttctgcctcgttaggtgggacaggatggttacattgggctggagttggttatttcctttcttccaggaaagttgggttatgatagaaccccaacaggttgaattctggttaaccagtttctcctgaaggcagaccttgttaagaacacagcgttctggcatattgcaaaatgattcattttcatcttttcctgctagaaggacaaaaagatttttctccaatatttgctgtgaaaacctggttgagtcccttggagcaaaactcacaaagtgtgggacccgtcctttgactgggtcctcctggagttttaactctcagactccttcatacttagcctctagcaatttgtcaattacagttcaagtttctatacccaacctgtgaagaaggttcatggcattctagttactatttcaaagggaggactctaaacatttccacccactgcactttgggtgcacaaatctatagtgagacagaatactttcacacaacacattccatgaagcagatttattacagataggcagcaagggacaacagaagcctaggactcatgacaaagctgtcccccaaggttcaggaaagcttcatgagatggatggaatctcatctgcatgcaacttatgtcacactgcagctaagggaccccaaaaagcagcctgtcctcggctttataccctgaggcattgtgatgcactggggaaaagcattgtaggatattctgctctaggaggaacaggaacgcagtgtgggatattctagccagttattccttatctcaagatgttgcattcccagcacatttacagctattaagaactacaagggccaggagcggtggctcacgcctctaatcccagcactttgggaggccgaggcaggcggatcatgaggtcaggagatcgagaccatcctgacaaacatggtggaaccccatctctactaaaaatataaaaattagctgggtgtggtggcacacacctgtagtcctagctacttgggaggccaaggcagaagaatcgcttgaacccagaaggcaaagcttgcagtgagccaagatccagccactgcactccagcctggcaatagagcaagactcaatctcaaaaaaaaaaaaaaaaagaaagaaagaaaaaagaaaagaaaaaagaaaaataactacaagcaagaaatcaaagagagttgggttggcccaaggccacctggagaactgtcagccagcgcttgttcccatagaggtttttgcttcagcatgttgtgattctctgtatccctcatctgtctctttaatctggggggcagcagtttgccctgtgaccttacttctgttttggatctaagaagagttgttggtttttcaatttgctctgctttttatgtgttgttagaatagaatggcaacttccaagctccttacatgaagaaccagaaactacaagtctccataccatttttcaagtatggctttacatttttaaatgattgaaaaatcaaaacaatgatatattctgacatatgaaagctacacaatatcaaaatgttagggtccataaataaagttttattggaacacacacagcagagttaaatatggcccaaagcctaaaatatttactataaccctttagagaaaaatgtagctgacctgtgggctatgtgtgctaccgtaacagtgtgacactttctacccttcttgactagaatactaaaataatccaataattattttatgttttccaggaaatcaagtaaagcagaatattattaagaaacctttagttagaatttttaaattagaaataatttctttcatagtcccagaaagtatataatgggtgaagtatgaatgggtgaagtatgaatgggtgaagtatgaatgggtgaagtatgaatgagtttgaatttgcataactgttaacattatccatgtttcccccctctctatatatacacatatacacacacataaacacacatatacaccagtgatatcctctacaatgaaacatattaattattcctgtactttatttaacaccaaagtttcttgattttgtttttttattagtagatagggctattttctgaaccctcttaccaagtcctctaatgactttagagacaactgtatcttatacactttttaaaagcaaatctcccttccttgtccagtatgttgtgagcacagcgtagaacatttgataaagacttagtgacttgaattaaattacttgcagttaagtaaaacatcccaaatcatgaaccctcaattatcttgtctgtgtttaccatgtcctaaggcctttcaaatagaagtgacaatttaaaagttctaaaataattacagcaccatattgctcactataaagtacaactgtcaattacaaattcaattatcagtggccacttgtgaatctagagaacttcacaaatgttctgtcttgtagctgaactggaaatgtttttagggttgccgtttgttttatagttttaaatatttataacctgattaattattttcctaaaatattttcgttctagctaaaaaatgtgctaggaacaaacacaatacctgctgaaagtgacttttgtccctttcggtgtagggataaatgttatcccacctaaataatatgactcttgtttttaattaggtttaaagtaccctttgcagtttgacctttccctggaatgatccattttctatgctacattttatcatgctgccagtaatgtcatcaaaaacttttaaagaacatattaaattggctttaaatttatattgagctttaaaatgaaacagcattaggacattgtgcttctttgttttacacctgcatactcttaacattccggtgttggagactggaattcttttcactccaagtactttaagttaggaaggaaagaaggaaggaaggaaggaaggaaggaaggaaggaaggaaggaaggaaggaaggaaggaaagaaagaaagaaggaaagaaggaaagaaggaaggaaggagggaaagaaggaaggagggaaagaaggaaggagggaaagaaggaaggaaggaaggaaggaaggaaagaaggaaggaaggaaagaaggaaggaaagaaggaaggaaaggaagaaagagagaaaggaagaaagagagaaagaaagagagaaagaaagaaagaaagaatgaaagaaagaaagaaaactaagaagttatttatgctttgtacaacagaatgggcacacaaggattctaacaaggatttcaattctaatatcagcacttagcccctcaatgtctttgagcatgttaagttgcaaagcccaaacggccttatctgataaggtgtcattatcccttctttgcaatgttcttgttagagttagaaataatagatgtagtgcaattgtcaccataggccctcaataaaagatggttgttgttgcagctgttgcaatatgatcgaggtctttactgacccagtgaaaaccttctactgcttgctctaagaaaccatttccttcttcctaattagtcctcagtaaagtgaataagttattagagaacatggtctaaaaacaatcatttatattaggacttcatcgtgtagttgaaacgtcatgccatggcttggaaatatcatggaaatgtggcatgaactcttcccggggtggtaggagatcaatgaggagcattgggagccaagaaaagaagccaaaaaaaaaaatcattagaggaaactttccttctctcacccatgtgcattttgaattcaacatatcgttggcaggttttctttaggtcaaggacagctttaaagaaaactgttttagatcctccaactctccttcataaacctatcccactacatagctttacaaattgcctcttttggagattttcccagaactatcctcttcactctgcacacagcaagaaattagccttccgctcttttactattccgttcctttacaattcatgctacttcagtatacttaacccagaatttattcaagttttatgtgttaatttaacaaatatttatttagtgactacctttattgtaccagttaaacatataacaggaaacaaaactcaaaaacagttctgtcctcactgagcttatattttggtggaaagatacagacaattaattgaaccaaataaattatagtgtatattagaaaaggataagggctgtgaaaacaaataaagtaaggaaggggagtgaaatatactgggaagtagagtttcaattttttagaaacagcttccctgagaagatggcaatttagtaacataaccaaggttgcaagtcaggaggttattcatggtgaaagcaatgtaggaaggaagaactgcaagtgcaaaggccaggaggcaggaagatgccctgcatggtccaagaagataaaggaagcccttctggttagatcagagaagatgaagttgaatagggctggtgtggagggacctggagaatatctagactcttgtaagctactgaaaaaaaaaaatgttggcctttagtctgagtaggatgggaaacatttgaatatttgaatgaagaagtgaaatgatctgacttgtgtttttttaaaagctcattctaactgccacgttgaaaatggatgataggaaagcaagttgaaaaaggctgaccagttagaaaatattacaaatatccaggtcgttttattggtagggctagaaggaagtggttggactctgaatacgacgtgttaacagatggacgaaagggaacagtgacagtgagggtcatggaggacatagaggtttttggtttttgccctggagtattagaaagttcaaagttgtcataaattgagatggcaaaggttacatacagcctgcttttgggttcagtatcaggactgcaaatttaggcatgttgactttgggctctctactcatgattccagggaagatgtggaataggcacttgaatatagaaatctggaattcaggggagacatgatctgggggtgtacaacttgaagaattcccaatatagagatgatatttgaagttgtgagactgaaggagaatgctaagggagtgagtgtagaaagaaaaggtggaaagtctgaggctgatcttcatttgcactctaatattaatcggttggtgagagaggaagaagcagagagtagaagcagatgatggaggaatggctaaggattggtgtaaaggcctgcaaataaaatcgtgtcaaggaacagtagatgaacaagtaggtcaaatgctgctgaatagtcattaagatgaggactgaaaataatgatgagcctaagaaatgagttggtgtgcctgtatggagtagtttcaagaaagaatgaaagtaaaaagctattgaaaccagagaatacagattcttacttttgaaagtgagttttgctacaaaggggatcagaaaaattgggtaataggtacagaggaaaacatggttatgattatttttaatgaaagaaacgtgtttgtatgataatggaaatgaatcagtggaggctaaaacagtcagtaatgtaggagaaagggggaattgctggagaaatttccctgagcaggaaggggaaaggggctataagatctggtgcacaagagaaggatccagctttaggagcaaggacaattaatcttgttaaaagagggaagactgagcagatgactcactggttagatgtaaacagcctctcagcctttcttggagcattctcatttagatataagatactatttaagtaacgaaatatctaatcatatcatttcagtaaatttaaatgaagaatttccattaggatatggaactcacttttttatttttttattatactttaagttctgggatacatgtgcagaacatgcaggtttgttacgtaggtatacacgtgccatggtggtttgctgcacccatcaacccgtcatctacattaggtatttctcctaatgttatccctcccctagtcccccaccccccaacaggccctggagtgtgatggtcccctccctgtgtccatgtgttctcattgttcaactcccacttatgagtgaaaacatgcagtgtttgggtttctgttcttgtgttattttgctgagaatgatggtttccagcttcattcatgtccctgtaagagacatgaactcatccttttgtatggctgcatagtattccatggtgtatatgtgccacattttctttatatatatatatatagagagagagactagatagaaactcttaaatcctaatatgcaaatctaacctgggaaaaccattacactggttaaaagtagcccatttgggatgcacaaaattcatttttttccttatgcctgacaggacatccagcaactccagtttgtaaatgagcttattcatttgaactgggatccatagctttactcaagaatgaacagcttggttcatctctccttgaaaattgctgttagaattaaactccttagtcaatcttttaactcaactgtttcaaaactcctttggttttgaatcaataaaagcattgaggatgtggcagttgagcagatgggtggtccacttggtaaagctttgttatctccatgtaagccacaataaaactctgacctgacaaaaagaaagtgtttacacaaatcaaaacagaaacctctatactataagttacacagtgtttccagttggtatctacaagtattaatgcagacacagtgacaggtttcaaataaacttgatagaaaaggccattcatattttatcatgttgggttgatggacttacaattgagaacaatgttttactcaagcttagtgaaaactcctaggtagtaatcaatattctcagtcaccattgcattgaaaatatgttcttgtctatgtcgacaaaggcatcaaattaaacttgcaaaggtagattattttttatcttttctcctgatgtaacaaatacatattataactgaaattgcaatataataaattaaaaaataaatgctattcagatttgaaagaaaataacgggacatctaatccatggctctattaatgctttatattttgtggcttaaaaccatctttctaaatattaaatataaattctgctaaaatagtgagggggacatagttgaaacttactatacatcaaactacgagtttccaatctttaagcaaaaatatagttactaaaatgttgtttacaaattatttttaaaattttaatactgacatgcaattaaatgatccaaaggcttcatacatttaccacatgttaaatgaagaacacgcttttgaagaaatctgaggtttcataaactgttatttactgagtttgttttgcatccaagatctcaggaggatttaatctttcatctgtttttcaaagcctcagttacattttattttttattttttgaatttatttatttatttatttattttttgagacagagtctctctctgtcaccaggctggagtagagtggtgcgatctcagctcactgcaacctccgcctcctgggttcaagcaattctcctgcctcagcctcctgagtagctggaactacaggcatgcaccaccatgctgggctaatttgtgtatttttagtagagacggggttttgccatgttggccaggatggatttgatctcttgacctcgtccatgtcagcctctgaaagagctgggattgcaggcatgaaccatggtggatggcctgaaatatttaattgacataacgattatacatatttaaggggtaaaagaagatttgatatacatatataattatcacaatcaaagtaattaatgcatctatcctgcattaattaatccaggctgtacattagacctctagaacttgttcatcttataactgaaagtttgtacccttgaaccaacatctcctcatttactccacaccctatcccctgacaaccactattctcctctttgtttttgtgactgaacttttagattccacatatatgtgagattatacactatttgtccttctgtgtctggctcattttacttagcctaatgtattagtctattctcacactgctataaagatactacctgagactgggtaatttataaagggaagagctttaattggctcacagatctgtgtggctggggagacctcaggaaacttacaatcatggtagaaggcagaagacaaaaaggaatcaaagcacgtattacatggcagcagacaaaagagaagagtgaagcaagcgggaactgccaaacacttttaaaacatcagctctcctgagaacgcactcactacaatgagaaaagcatgggggataccgtcttcacgatccaactacaattcaagatgaaatttgggtggggacacagagccaaaccatatcacctaatgtcctccagtttcatccatgttgtcacatatggcagtgtttccttcttttttaaggctgaataatattctattcaatacagcacattttctttgtccattcatctgtgactgacacttaggttgtttctattacatatcttggctcttgtgaataatgtggcaatagacatgggagagtagatatctctttgacatactattttatttccttttgatatatacccagaagtgggattgccagatcacgtgatagttctattttaaggtttttgaggaagctccatgatattttccatagtggctgtacaaatttacattcccactaacagtgtacaagagttcacttttctttacacccttgccaacatttattatcacgtgtctttttgataaccatcccagcaagtatgaggtgatacctcattatggttttaatttgtatttttctgatgattagtgatgctgagcatctcttcatatacctgttggccatttatatgtctttgctggaaaatgtctcttcaggtccttggcccatttttgaatcaggttatttttaaacattgagttgtgtgagatctttatatgatttggacattaactcctcatcagatataaggtttgcaaatattttcttccatatcatagattgcctttttattttgttaattgatttttgtttttgtttgtgatttttgctgtgtggatactttttagttttatatagtcctgcttgtttatttgcgcttttgttgcaagacacaaaatcaacatacaaatcagttgcatttttatacactgaaaacaaaccaactgaaacagaaaataagaaaatgatcccatttataatagatagcattaaaagaacaagagacttaggaatacatttatccaagaaggtgaagatctgtacactgaaaactatcagacatttatgaaagaaattgaagaaggcacagataaatgaaaagatagcccatatacatggattggaagaatcaatattatttaaatgtacatataaaccacagcgatctacaaattcaaactagtcatcaaaattccaatggcgtttttcacggaaatgccgtttcacagaaatgccacagaaaagacaatcctaaagttttaatgaaaccacaagactgcaaacagccaaaacgctcctgggaaataacaaagctggaggcatcacagtccttgctttcaaattatgttacaagactatggtagtaaaacagtatggtctggcataagcacagacacagaaatacaacaaaagagagagcctagaaataaatttacacacacattatcaactaatctttgacatggcaccaaaaatacacaatggggaaaggatagtttcatcaataaatgatgtttgggaaaactggatattcatatgtaaaagaataaaattagactcctgtattatccaatgtaaaaaattaactgaaatggattcaagacttaaatgaaatatctgaaaccataatattcctagaaaaaaacgtagggggaaactttctgacattgatcttggtaatgacttttttaaaagcgtttatcttttctttttctgaagaacaattattgaaaccaccatttcagggtgatctgtaactggtaagcaaaataaaccatgtaaaagaggagaagccttgagtgtagatgaatgtggtttctctagttcaatcataacattaaaatttcataattaaagaaaattagttctattatttctgtatttatgaacaaattggacaaactattatcttccaatctgtaactgtacatgggcttttcagattgattctacctaaagaaaatcaaaacgaaggtttatatattccttcagtaaaatcactcatagtttcccttatttagttagcatggtgtctttataaacagatgacttaaaagtgaacagaaaatggagaacaaaataactcaggatcccaccttagagataaagctctcatgactgttttagcagggttaacaaacgttccctatttcttccataagttaggctgcctgggtccatgacacggcttgatggacagggtgatccctagtcacctgtgcgcagctgctgcttctgccagctgaactgttgactcacagagtctgcaatatttcttttcttacattaaatttaagccatctttacttgctattttaattccacaatttaacaaattataacataaccctaataaaatgtgatatgtagagaaaacaaactttgtcatgaacacctactttaatgatttgtaaagactccaaagtgttatttaagtattatattaaagtattgtggtgtgagaaccataaaattttgaccaaaaaagcaaaaaaaaaaaaatgcaacaaaaattaatagagacagttgactactggtcacactctaaagaaattgttaatattatacacacacatacacatacacatgtaatttattttttaaatactatgctgcagtgatccaattataccttatttgaaaaaaggaaaaaagtcttatataaaaacattgatgaattaatgaaaatgtatatgtctaaaacaaagatatataatttaaaataattttcatcttttatcaaatattttgatttactatcagtcttgatcatattatttccatgacagtaattatttgctatattcactctaaattcactgtctttattacatctctttgtaattattaatgaaaatattccacttttaaatacctatgtttcccaggggttgctttgtgtaaaaaatattagcatgctacaaactatgagctatccacagtaaaaaaaaaaaaaaaaaactcaaaagaaaatctaattgctattttattcatttgattttataacctcaaactcacagaatactgaagaataaacttttctcctgattcatttgcaagtaagtgggcaagtttccatccatcatctccaaatacttttgtgtctgttttctacaagcaagaacattattctacatatccagattacatccatcaaaatcaggaaattaacattatttcactagttctttctaatcctcagattccatttgagtttcaccagttgtcccaagagtattctttttttttttttttttttttgagaagaagtcttgctctgtcactcaggctggagtgcagtggcgcgatctcggctcactgcaagctccgcctcccaggttcacaccattctcctgcctcagcctccagagtagctgggactacaggcgcctgacaccatgcccagctaattgtttttgtatgtttagtagagacagggtttcaccgtgttagccaggatggtctcgatctcctgacctcttgatgtgcccgcctcagcctcccaaagtgctgggattacaggcatgagccaccgcgcccggcccagagtattctttatagcaaaacgatgcagttcagagtcacatgttgcagcgagtttcattgatccttaatttccctcagcctgggagattgctgtctttccttgacactcaagactgaaattttatcgatgaggccgtttgttttgcagacttggtcttcatttgggtttctctcatggttagtttcaagttttgcatctttggcaggaatatcacaggagtgatcctgtttcatactcatcatgccaagggctgcacagtttcaagccatcccattattgtgattatttgatgcagacgctttgatggttaatgttatgtgaactgagctaggacacagggtgcccagacatttagccagacattatattctgggtgcttttgtgagggtgtttcctgatgaattggcagactgagtaaagcagaaggggctccccattgtggaagagcctcatccaatcagttgaaggcctgattagaacaaaaagactgactcttccccgagtgagagagaattcttgcttgctggccttgacttagacattgtttttttttcctgtctttggactcaaactagtattaaactataggctttcctgggtctccagctttccagctcacctggaagatccttagacttgcgaggttctgtgattacctgagacaattccttacaatgaacctttttatagagatggagtttttggtgtgtgtgtgtgtgtgtgtgtgtgtgtgtgtgtgtatttacatatacacatacacgtgtatcctatttgttctatttctctgaagaaccctgactaatacaggtgttgtgtaccagacttccccactatgagaatgccttttcccttggcaattagtatttttgtggaggtactttgaaatataaatgccttctcctaatcagatctcacatttatttctttatgtacttatatcggtatggattaaaagtgtcctattttatttaaggtgtaataatccattctcgcttctattttttcacactgaagcccacattgttccagatttaacccatgggagccccttccagcaggtgtctgtgtcctttcattatggtgctatcatttcgtgagtgtcttcctgctttctggcagtaaatgttgttccaaaatcatcttgtattttcccaacttggaatataataagcccattcttcaaggtcctcccagtagatgcccgagggactacatgcacatctgtgtgtagatgaataacatacttattcacaacaatacttaatttgctacttttaaatatgaaagaccgtgaattcacacaagtacttccaatgccaacccaatgtcatagggttcattccagtcttcctctttgacataatttgactctcttttccaactggaaaaatcctggctcccattgtctttgatatacttatttatatacttaacccccagttataagcaatttcttgtcactactgctgccatctctccatgtctggataccctccaaacctaactcaggcactgacctccccactgcaggaaactccccctactgcagggacgctgtcttcactaacacttcatatcaagccattctcacttgagaaagcctcttcacctgctcagactctgatacgctgtgtgggctgcccccattccttggttgccctaaaccccactggctctctgattttccatgcctggctaattctctatataactgtgcctattctgctgtgtgtcacctactgagttttcatttcaacaattacattttattttaagcttgtttttttttttttaacagtctatcctcctttaaacatttcatgtacttaatagtctgtatctgatcattccaatttcactggagtctgtaaattttgtttattgtttgtactcactctcacttgtcgtattccttcaatttttttttctttttggttggttttttttttcttttttaaatcttaacctgtaaaaatcccaattgtctaaattgagagtgctttctctagaaagaaatttctattttattctgctcggagctgggggcactgccaacaatctagtcaactcctgtatgacttattttgatttgatagcagaaacctgggactcaccttagagttctcctatccccttatctcccacatccaattactcaattcatccaactccacttcctaaaatcctcccatccagtaacctaaagcaaccctctattgctcaccttccacaatgctaaagactgatgtaaaaataaaccttaccctgtgattgccatgcccaaaattcttaaaaggctttaggtaaaatttataccctttggattgtcaaaaacatgatgacttaatcttttcttgtctgcgtatctagccacctatcatgccacttcctttagccttcacctcctcttttttttttttttttttttttttttttttttttttgacagtgtcttgctctgttgcccaggctggagcacagtggtgcaatctcagctcaccgcaacctcagactcccaggttcaagcaattctcgtgcctcagcctcccaagtagctgggactacaggcacatgccaccacaccaggctatttattatttattttattttaagtagagatgaggttttgccatgttaggcagtctggtctggaactcctgacctcaggtaattcacctgccttggcctcccaaagtgttgggattacaggtgtgagccactgtgcctagcctagccttcacctcttgaattgtactctggcaataacagactctgttgttttccaaatgtgccaccatatttctgcacatgcccagggtaacctgtcttctctaactagttcaagtgctggctccactttgaagagtgtatcttatctacaactccatgcagctcatttcactttgcgttatgaatgcttatttgaatgcctgtgtttataatgaagtgcaatttctttaaggtcaggggtcatgtctattcacttgtgcatttccagtttctattaaagattaacatggaataaattctcaagaataatggctgaatccacttccagcatgcaataagcaattactgctggcatttgtacaagtacacagtggtggaaattcagtcatatgtacatttctatcaactattactaaagcagaagtattatgaaacagttaaaaaatatacatgggttatgattatccctgttcattgaaacagtcctggaaaaacattttttatcaggttgtaaacactcactttaaaaattaataaaaagttaatataaagtctagaaatttaaattccatgggatagtgctaatgacaaaatagtagtagaccctaaattgtgaatttcaattttgaatttcaaattttgttttgtgttttatttttttgagacggagtctcgctctgtcgcccaggctggagtgcagtggcgcgatctcggctcactacaagctccgcctcccgggttcacgccattctcctgcctcggcctcccgagtagctgggactacaggcgcccgccaccacgcccggctaattttttgtagtttttagtagggatggggtttcaccgtgttggccaggatggtctccatctcctgacctcgtgatccgcccacctcggcctcccaaagtgctgagattacaggcgtgagccaccgtgcccggcctcaaattttgaatttcaaaatttagggtctactactatgattgtcacgagatatagtccaaatttcattcctacaaatatgtgtgcagacacacacacacacacacacacacagattttatctggatatcctctagttgctttaattctttctaaatagtcatctaaatcctgatgaagcaggagataggtttagtgatggtttcaatggaatgctatcgaaaattttcattttgtttttttttcacatcagaatcaataaatgttagccaactctcctgcttaatcgtcccattgagaatatattttatttcttagtgtctgtgcctaatatagcctgtttatatgaccacactagaagcttgagatctagtcctacttattatttcttcatttagatgtatttccagtaaacgtaattaaattcaagctctcagatatttctttcattaaccatttattctccctttctgttatcagatacagattcagcaattaatttcctgattaataacaattgctatgaaagcatcattcagtccactaagttgctgtgtttctagaagatttgattcaaaggtttgttcttatttctggcttcaatatccattgttaagtcttgccctagggtagaccacaagagatttagagcaactaaactatactaaattggttataattcaatgtagtttaatatacaaggaaatggataatctatttaccatccaactcaaaagaagaaagaaaaagagagtgagagtgcaggtcattttataggaaaggaatgtttttaagaacctatcaaagattctctcagtcagtagatagatggtatgcaaaactctgcttgataaaaacattgcaaaagtgtttttgtactttttttgagtttacatctcaaaacctgctcactttcgggtgtggtggcttacgcctataatctcagcactttgggaggctgaggtgggtggatcacaaggtcaggagttcgagaccagcctgaccaacatggtgaaatcccgtctctactaaaaaaaaaatacaaaattagctgggtgtgttgccggtcacctgcaataccagctactcaggaggctgaggcaggagaatcacttgaacccaggagacgggggttgcagtgagctgagattgcgccactgcactccagcctgggcaatagagcgagactccgtttccaaaaaaaaaaaaaaaaaggacactttattggtacgcattcatgactgtgcatacatacttaaagttaataaccactctaatgggcatagaaactttctgaaaataatgactatattatgaaggacaaatacagtacagtttaaggaatcttgcttaataaatatttaagggtttcattgccatttctagaagttaaacagaacaaaacacattgtaaattctaaactattcctgcaacatgattttccatgaatctacaacataccgtattcattttatagatatcatcatcctcttttcagtaattgaaagtattttccacaatactgagtcaagtggcgatatgaatatgacaggtgtgagctccaagtcgtaatgcatctttttcatatataatattttttatttcaaagtttttggggtacaagtggcttttggtaacatggatgaattatacagcagtgaattatgagattttggtgtatccatcctgcaagtagtgtacattatttcatctttgccacttcctagccaagtgattttggaaaagctgataaactttttatgcctcatttttttaatccatagaacgaggacaaccatagtatttagcctggcaacatagcaagatgccgtctctacaaaaaaaacatgaaaaacaaatcagctgagtgtcatggcatgcgcctctcgttcctgctactcaggggcctgaggcaggaggatagcttgaaccctggagagttcaaggctgcagtgagctatgattgtgccaccgcactccagcttgggtgatagatggagaccctgtctctaataaaaagaaaatgcatagtatttattttataatgtcgtggcaatgagcaaatacaggtaaaccagtcacagtaaaatctcaataaacaaggtgattagctcactacacatctacataaaacataataaaacaaaacaactttatttcctattttccttcccaagctccaggcgtttcacttccaattttggagtgaacaattaagttaattacttactgtgatttcacattacctacgtttgactcagctgtctatctccatagcctctgtggtgttcgagttccctcagtgtgtcacctttctcattgtcttaggagttttcactgcaggagactctgcagttacggagcccacagcactgagtaggtctcagccaatgtttggtttggccagcagcagagtactgacatcatgtttattatcccaacctcactttgtttaattacatatttgtaaaagaaaacaaatactgaagatatatataaaaattctgtgtcgaagggcattatttctacattatgactcctttcatttaaacatacagacatttggtaccaaaaagaaaatatatttgagccttttggattcatttatttgggggtgaggtgggacacttttatttcagtgtcatctgttttctcgattttgtaaaactaaatggttccatgtttatttgtatggttgaataaacatcataatgcaggtgcaatgcccagtttcaggcagtagagcatctgtacttaaaagaccatcagatttgtattaagctgttgaaatttgactgcatagttaggatcagacgttgcttcaaggtacaagaatgaagcaagtcaatctttaacaacgtttctctctgtcatggaggcagctactgtctttaagagcaaggacaaacacaattttcactttgttagaattctgggtcattctccctgagctctttatatcaaagcaatggcatctctggtcctagatacaagctctaattgtttctccttttagaaaatcatttttctctgccgggcgcggtgcctcttgcctgtaatgccagcactttgggaggctgaggcaggtggatcagttgaggtcaggagttccagaccagcctggccaagatggtgaaacctcatctctactaaaaatacaaaaattacctgggcgtggttgcatgcgcctgtaatcccagctactcaggaggctaaggcaggagaatctcttgaacccaggaggtggagcttgaagtgagccgagatcgtgccattgcactccagcctgggtgacagagcaagactccgtctcaaaaaaaggaaaaaaaaaaaaaaaaaaaagaaattgttttgctcttttcttccctattcttaggcttctgaactttttttgttgttgttgctctctatccttgcaactcctcatttcaatgttgaaacaactgagaggtgaagtcttcgtaaatataatctagaattgctagataaaataagaggcccagttaaatttgagtttcagataacaaatgatgttttagtgtaagtatggcccatgcaattcaaatttgacttggtgtactgtgtttttatttgctaaatctggcaagcctaatctcatatctagttattgaaacacgtttataaagcagaatgatgtataaaaaaatctgagttcaaatatgttcacttttatttcttcgcaccatgcaaaactgccgactgtcctcttggatttgaatttccttcttttcctgattttttcatcgctttgtaaatgtttttctttgactttctctcctccttacaatgcaatcgactttatcattgtttcttcagtgtcctgattcttttattctacctcaacatctttatttccccattcattcttctttgtgaaaaaagaattccaaaatgcttattacctcagtattttctctgacacaagtttgttaagaaatactcaaatttttaatacaggtctttgttctactgaaaaacatttcctttgccaagtttagactacattaaggacaaatatcattgctgtagtccatgcacccagaactctgtaataaatagtagtacccgcttcttctttacatgtgtccagttctgtaacttctatttgggaatttttgtttaattataatccatgtgtatattccttgaaatctgtggtagtatgacagaaaacgagtcttcatttggctggtagattctctagcctttcccttttcagattattttgcatcttattgccagctttttaaaaactggtaccccgatcgttttgctgcctgtacctcaaagttttccttatcgctcttttgatcaaatataaactttaaattcttccatttattatttcttctttgactcgcaatataccccattctaatttggaactatttaaaaataaggctgctaactagaagtctctgcacatttctctacccatcccaaaagtttggtccactctaccttcctcctaagtaaaaagttaacaattctcctttccttaccattaactttttaaaatcacttatgagacactgactttgatcaacccattgatcttttttcaggctaccattcttatgtactttaacatgttttgatgaatttgtggtcattataagtattgaatgttgtattccacactatgctttgcatttttttttttttttttttttttttttttgagagggagtcttgttctgtcgccaggctggagtgcagtggtgcgatcctagctcactgcaacctccgtctcctggtttcaagtgattcccgtgcctcagcctcccaagagctgggactacaggggcccaccaccacgcccggctaatttttttgtattttggtagagatggggtttcaccatgttggccaggctggtctcgatctcctgacctcatgatccacctgccctggactcccaaagtgttgggattacaggtgtgagccaccgcacccggcctgctttgcttttttaaatgttgcaaattagaattcttttggttatcttatctaattttctatttttatgttatgtgtcagatagtctggacttacaggaagacctgtcctcttccagcacgcacccttcctcctcccccatcattcccaattcacatgactttctaactttctaattgggtgctttttaatattcatgagcacaggttttaggtcacacagctttttataattatgggaaaagtaaaggtaaatagtgggtgggtactcaaggagctcacctacaaatcaacttgattcaatctatttaatctattgcttatgttctgatttttcatcagtgtcctggtcattgcttaacaatgcaaaatttgtggataaaaatattcatgttaggtgaagctcactgactagcctacaaatcagtgtcaccaattttgatacattttatccacatctccattatctggttaacatatcattttgcaaaatattaaaagatcttcaggtcacaaagggctgtcatgaacaaagtttcttctttttttaaataaactgaacagtgttactatctagttggcaccaaggacacactaaaattgtaatttataattatggggtttttcctcacagaaataaaaataaataggtcttattgaagacatagacagttttgcttctgtgaagatttctcctttacacataatcagtctgacttttctcactcgtttctgcctgaggtggaggtggggactccattcttgacttaataaatctaaattcttcaactgtcattctctcccaagacacttcaccctttggggactatgctgcattttcccattcttgctctttgtacatttcatcctgggtctggcaagacctatttcaaatatacaaagttatctgatacacacaggaacccaacctactctccacagagtgtggaagggttaaagaaaagccacttctgaacatctccgctttatcagctcccgttgggagatcaggggccagcagccttcattagccaataaaaagaaaatgacgtttctttgcaaggagtagactttactaagcaccctatatgttaaaaaaatatatattaaatgttagtttttgtctccaaaatagatatataattctcagatttccttgtaattttctcttaatggctgattaaatcttgacaatataaagcagtccagtcatccacccattcactggacaaatatttcttccatgtaaatgccaggcaccagtttaggtcctgatgatacaccaatgaacaagaaagatgaagtgatgatccaccaggaacttacattttagtgggagagatacacataacaaataggtagatgatatgataagcagggtaagtagatggagagcagatttttaagacttctgtgagctaagacctgattgaagagaggttgtaattttgtggtgtcagcatgatcaggccaagtaatcacttcctattgcccatatattttttaatcatttgtttaaaaatataatgcaaagagatagttctcagactgttttctcatatagaagatacttatttcttagattcttagtactactcattttaataagctatatgagtccacaacattaaaaaatttactctagaaagtaaagctgggtaaagtgacctcagtgtagaaaacttttattatatggccacaaaaggcactgaaaacgaaatttctagagggccttaggggattaaaagggaaatgtttagaagacattaaacctctggaggtttaattttgcaacttccccaaatacttagacgacttcaaaaataattttgcttttgtctaaactcagaaattatattgttcttttttgcccttgctggccctcagaagagtattaattctcattttgggaaggaattattttaatcatgccattaaatgagaggaaaatatcccttttctaaaaaaataaaaaattaaaaataaaaacctcggtgtaaagtggaattctctagagaatgcattgtgcacaaaatgaccttcctcagtgtattactgggatggagggagtcgtctctctgtggggtagcaaataagccctgtggccccctcaatccacctcagcctccacagagcatcagttgctgtttcatcccgggttggtccagacagccactgccagtccactagagggagcacttgagaggaaacccatttgctttcattgatctagatctcaaataaaatttcatcttagaggctgggcgcggtggctcatgcctgtaatcttagcacgtcgggaggccaaggtgggtggagcacgaggtcaggagttcaagaccagcctggccaacctggttgaaacccccatctctactaaaaatacaaaagttagcgtggcatgttggcagtaagctgagatcatgccactgcactccagcctaggcaaaagagtaagactctgtctcaaaaaaaaaaaaaaaaaaaaaaaatttcattgtagaataaaatccaattcctttcagcttttatcttcaaattttggtcattgtttgcattagtcattgttcttcaggaaaacagaaccaataggatatatgtatctgtgtgtgtgtatacacatatatatgcacacatgtatatatttatatatacaaatatatgcatgcatatatatttacatatacacatatttacaattctgtaaaatcttatatataaataagactcacacatacacatataacgtgcatatatatatacacatatatatggcatatatatatatacatatatatggcatatatatatatacacacatatatatggcatatatatgagatttattttaaagaagtgactcatgtaattatggcagatagcatatccaaaatttgcaggtgggccagcacgttggaggcccagggaagaaagactactgcaaatcaaatctgaaggcttgtctgctcactaaatatcctcttgcctggggaggtcaacctttggttctgttcaggccttcagctgattggatgaactctcctccctctaccctcacctcaataagaaggatgtcttagtttctccaggcttctataacaaaatagcatgcaacagaaatgtatttctcacagttctagaggctgggcagtccaagctgctggcagattcagtgtctggtgaggtcccatttcttggttagtagagagttgtctttttgctgtgtcctcatacgatggaagaggcaagccaattctctgggcctctaagggcattaattacactcatgagggttctgttctcataatctaatcgcctcccaagagtcctgcctcctaatatcacattagtgactaggcttccacatatgaattttagaggtacgcaaacattcagatcatagcagaaggtgatttgctttactaaaaatcagcaacttaaatgtaaatctcatcctaaaataacctcacagaaatatccagagtgatgtctgaccaccatggcctaaccaagttacaagataaaatcaaacatcatgctgtttctgtatagtgacactaaaaatagttgctaaaaacttgtatgacaaaatagaaaaatgaaagaaaggcaaattattttggaaagttacagtaaagaacataatctaaacccaacaaaaaagtttctgagactcaatcactgaacagagttggaagaagcttttattcacttcattccactgtatttaacaagtctctacttcagtccctgtggggtttctaatattataaaaagtaatatcataggttataaagatttagaaagagtgcttctatttttgaaatcaataatccagctaggacatattttctagatattattataacatttttacattaaagataatttcttgttatttgaattttatttcccctctcctcggggttcttagtaatacaaatgagtaaaattgctttcagtaggatgctagacacattgtactgtttgcaggtctgctaaacaacagaatcaagtcacctccttggcaggtgaccagcattaactataatgcccatcaaaacagtcaataagaatcacagatctgtggcaccatagaataatggcctaattaatctctgttcaatttccatttttatacctgctcccagattcccattatttcttatctatgagttcttttctcatttgaaaacatcttctatggattttccttcattcaatcagttgtttttacattcattcatgtttgcattcaaagatatttactaagaacttagtataggttatacatttatgaatattattcaaacactgaagataaagattgactgattaccacagtggacagagatacattgctgttaaaaaaatctgagtcctttaaaagttttttgtttatcatttgcaagagtatatggaatactgaagtttcttctaataatatcaaaggaatagttaaaatgccatagggactaaatgttacatatgtaaagtaacatagccatctggtctgtttcattcttatttccttaggagaagagtgttaagcatgctctaaaacatttattgagggcacgttttatgcttacgtttaggttcagttttaggtatatagaaattttaaaaggaaaaggaaaaaaatttttaaaaaaaggtataaggggatgataaagaggaggccagaaagaaaagaaaatacagtttctctcctttcaattccttaccattactttaccattcttgtgtggaagtgggagggcgtatccacagaggggtagaaataggcaaataccacataaaagggataattgcaggttggataaccgcacacattggaaccaaaactgcttccgaaaaggttataggatttagatagtgccaaagactaagtctgaaacacatttaaaatagttgtttatttacaaaatttggcacaggtccccgtctattgctacttttctgtcaacagaggtttaaagtttttagcagtgaaagttttatatagttaaaagagactgagacaatctctggaaagcattttattaccatgggattcccttttttgtgtgtggaagtgggagacctcctaattggtgttcaggtacacttcgcagtcttggttgagtgcaaggaggcaagtgagcagcatggagacattcaaagacaggaggattgtcctgggttagggtcagtggtattttctccatccagctattttctgtaacaaaagggtttgatgagttacttttcttgtgaccaaactctcttaatagtcccttatggggccggtggctgtcatggcagtttgtcattagtaaagaagttgagactactctagtttggcaaacaatatgaataaagtgacaaggtgatgatgagcatgcccatagtcttgctatttaaacaatgattattaggccactccagtgaaagataatgagaaatagaacttctgcttacagaagatgaattttgaatgcctaaggtttaaatttagatttgatgggatagaactttgcatattatttacatggttttgaaaacaggcatgaagagagaacaaggttgtaaggagcttaggacagaagagaccaagctgtcttataattgagtcaggacgaagcacaggaatgttactttgaatcaatgctggccttaatggtccactgatctatgggagaagaaaaaaaacttgatatttaagcattggtggaaaacacacacacacatacaaaatttctgaataccagagactgagggaaatttgtacccaacctaattagttgaaaatacaaagcaagtttcatcaatatagcttgtatagggttaagaaaaatacttaagcattacatgattgctgtaggagcccattttttggaaaatttccagggactctttgagtcaacttgttaaaaacagaagaaaggctaggaaagaaatagcttgttttatgcctgtgattataggatttcatcattatgtgggccactgagtgttattttctcaagttcatgcatatgcagagatttaaactaaatttgtgttctactcaccacgttaagaggcacaagttatcaaagttactaccaatacattctattcccccgaaagacattcaaaccataattctctcaagttaaaaaaattaatattttgtaaagtaaccattgtccctcttctcaatataatccaagtgctaacacctttgaacacaccaacaatggtctcttgattaaaaagaaaccacattaggaaagtcctttgaataacataaattgtctcctataataaaggaagacattggaggtaaaaaaaaaaaaaaaaaaaaaggtttcagcaccaatcttcaatctctctctcacaccacagaagattcagagctggagttgggaaatgcagtggacttgggtaaactgaggttttcagtcttcatactagtcagaggtcataattgattgagtccagttgtgatataactttgggcagtaattttagtcaattgcttcctaccaaagttccgtgctctttgctggaggctccgtttctgaaaagctctccctctgcccttctttctttttctctgcacacacaaccctcacgcagctttcatgctgcctaaatcagcctgtggattaggtattttctcattatccagattaaaagacagctcagtctcacagagatgtaactgactatttgattgaaactgacttttttccccattggaggcacatcagaatcacctggaaactttaaaaattctaataccagaccatagccttccaattctgattgcgtggatctgaatggggtagttccctggtcttactcttcacaagctccccatgtgatgttaacatcagccagcagaggctgcgaacacccataaaaacaaatccagatatgttaatagatgttagggaaagtgggagaagagggggtggtggatttgcaaatgttaaacttgttacccaaataacctctccaagtaaaacttttggaaggatagttttgatcaagagaacctgcccctttttggatctctttcacctgcaaggagaaaaaaagtgagaaaaggaatcagctttttataataaaaaaaatgcagatggagattccgaagtggctcttcagcgtgaggatcgaatttttacagggaaattccctctgaaatccttctagaaattcctgctatatcatctcccacttacataatcattgccccttatccactaagcaccccccacccccccatctgacagtcttgtcaacctcatgtgtctggattctcagtcttagtacagtccctctttcgggggagggagagctttggagtttggaggagaaggaggaaaagtgtgtgtctggcctgaaggtgatgatctaaaagaagtttccactgaagaaacacatctgggtgtttcacaatgtggctccttgtatcatctacatcacttggaaacttgttagtaatgcagattctcagacctcaccctggacttacaaaatcagcaatgaggggctccggctgagcagtctgtccgagcaagtcctccaggtgattctggtgaattccagtgcaggctaaagtttgagaactactggctatctcatgttttctcttgagcttctcttaccaaccttgggttgctttgttcctgtttgttttatagagcttttctttatagagcacccttggcataagtagctccatcttagaaaaagactccatcttacattttaaaagccatcatgccaacagggaccaggtgttcggctaaccaatagagactgcacccaaccagataaggacataatcattcacaccctttcactattagtcctcgctagaggactctgtggccataaaaaagagcaggatttcaccaattggaaactgctgtcttagcagacaccatctttctgtcccttgtgataagtacccagcatcccctgccgaagactctgcccacattaaaatctcttccttgcaagaccctgatggaccacctggatcaggacgaggcattgtttggtccacattgctctctctgaactggtttgttaacccttttttcctatctcctttatcttgatgttaaatgttactttgttgtggaatgtttagtcaaaacagataggtaggtaggtaggtaggtaggtaggttatgtgtggtttgcaatattgtctgacctgtggagtgacttgagcttgtgtgcctatggctctgccaagtgaatgggtagcactaaagagaattacctcctctggagcttcaggtagctcatggctttgatgattgaaatagcattggtgaaagtctgacattatggaaagacacaaatatttgtggacttggtcatgtctgactgtgcactgctcatgataccttcctattacttcgcctagagcctgaatgggaaagggagaggcaagcaactgaccaactagcaaacaaataaaatgaacctactgtgaacagaaaaactatttctgcccatagtagtggcttattgcagatacttatcttcagtttaaagttatctttgagtctctatgtttgtagctggaaagatgcagatgttttaaatcaagaaagttggacaagtttgttcctaatattccttccaagtttaattcaatggatatatgagtttggggattaataaaaaaaaacagcaaggagtaagaatctttgggaatataggaaaaagtgctgtattcaactgggaaatatctacatatttaaagacaacttctcagagaagatgattataagcccacattatgttttatttcaaacgtgctgttggatgaaaagttgctgaataagctgaattcaagattctcccctaggtagaaacatttgggtgaggggtggtggggagaggtcatacaatgaagaattgtctggttaaagattaggctacttgtaagatggattaaagatgtaggcaagtttcaaaactgatagtcagctgagtggatcttcccagaaaggatctttaagtatcatgagagtttatcagaaaattgctcaagtgttttattaggaattctaattattttcaggaagggctgtgaattacatcttgcaaaaaagctctgtctcccaacaggtttggtgacatttattttttctcagtttctagtctcatctcttctcacattttatcttttgttcacttttagtaagtaattttaacttcctggatttcaattgcttcctctataaagcagggataataatttcataccataatgaaataataaggctagaaaaataatttttcttttagactgttccaagttttgtaactgactaatctaaattatgcattggggggaaggtgatatgagatgtgcttttcagtccttggattcgatactaattataataccaaactcatggtagattgatttattctgtcacatatctatcaaacatttgcagtttctgctgttatgtatgctttatgcattttacaaaaaatcatcccaattacacaattactctatgatgtaggtacaagaattatccccattttatagatgataaacctgagacactgaaagtttaaatagctagcttacactcaacagtgtggtatgtggtttgtggcagaggctggatctgaactcaggaagcctgcctcttgtgttcaacaaacaattcactagttgatatcctgtcattccacttgattctccaaaaataaggttgggccttgtcaaggatcaaatgaagactggtaatcctaaagaagttgaacttcagagagcctcagtgggagagaataacatgcctagtccaggtcgttaaaacttagattattttcttacatagtattggctactgcccgttctgatgcttgtacatttctgttacggtcctcggtctctggattgaaccttatccactagattggagcataggcactgtgattcaccatgttattctggaatctaatatagaaaatgacccagaagcaccatttttaacaaacctgggttccctagccacgtagaagcatcagccagatccagctggagccaatcctgctgattagcttaacaggttctctgttttttttttttttttttttagaaaaagataaaatgttacaagatagaacatcgtcttattgcttcttttgttttattgcccctgccattttcttagagcattaaaaagaaatcactttctcagatggtatgaggatgaaaggatccacattgggaacaggaaaccaaagatctctgaagattttgaaagcagagaaagaataaccaggtgtacataatgataactaggaaatacaaaaccgctgtgagcaaaactgtttcttccagtttgggaggctccaaagtgaatcccgtgatcttagacacagagatcaggttaaaagagcctttcttccaggcagcctgctgctgcatgatgctcatcattccacatcctgaacaatcctcaggcttcaggctggacgagtggtctctaggtaccactgtgtacttaagagtgccattttctgagtgcatcttctgtgccaagcactgtgctgacatagtatcttattggcaactcttaatcttctatggcatcagtcttattcctattttagtgacaagggccctcttttgtaagtaacttcctccagccccacagtaagtgcgaaaaatgggattcattcctctgactctttgaatccaacccagtgcttgggtgtcttcaagtatctctgaattcctgacctctgggattcagtgatttttatggcattcatgtgatttctgtggtgagttccctccacccccaactccacagggcctgtctgtgaaaatgaaagataccagtcagggtgcaagacacagtctgttctcatggagtcagtgaaaacttcattgtatttgaaagaccctctgatcaccagaaggtcattcttgctcgccttttccttgactataaggttctataagttttttcgtaatgccacttacaataatacagtatttacaattacatcagaatgacaaaaacacagtttacaggagttagcacctccaaagcatgacaataataggaaaaatgtatcaccaagtactagtataaaaataaaattctctataaccaataatgttgaatcagagagccattttgaactaaagaagtttttgattcccttgtgttaactttaaacaaacttttttggttgattttttttttctattcattccttctgtataagaaataatggagaaatgtgttaaacttttagttaaatgtgtgtcaaagtttaatataaccatatggtttttcctagttttggttatatatgggaaataacatttgattcactcgaataactttacagttgaccgggcttgcttatgttggtgaatgtatttaagctcattcaaaacatacagcttgacatcttagaatctgaggaatgactttaggcaacagttaagccaatttttaaaattctcattgggggcactgaattgaaacgctgtaatcttctctagaactatcttctatttcgtgtttcagcaaagacttaattgttctttgaagaatttcttactctaaaaatcgtagcaatttatattccaaagaaatacaattatcttgctcagaaaagagaagaaatgtagaattgcctttatttctaagttataattgcaatcatgtattggcagcacatgtgaacaacttagatataaaattatgatggggaaaaaacctgcagcaagaagcaaagtgtgcatagataatgatcctctgccaagtaaaatgagttctatttatgtatttgtttaggcatattaagtgtctagagcagcagtaatgtgaactttacctttttggttgtttacctttttcaacacctatcaatgctgtattggtaaatattacatacacacacacacacaaacacacacagtcttgctctatccccaaggctgaagtgcagtagtggaatctcaactcactgcaacctccacctccagggttcaagcaaacttcccacctcagcctcccaattagatgggactacaggtgcatgccactacggctgactaatttctgtatttttggtagagacagggtttcaccatgttgaccaggctggtctcgaactcctgacctcgagtgatctgcccgccttggcctcccaaagtgctgggattacaggtgtgagccaccatgcccggccaaatattatatgttgtacgcattgggtactatgtattttaaagtcaattatgtttaactttgctcttattctataattttgcacctctggaggtaaagttaccatgccatataaaaaaaatggagataaaagtaatacattttacgataaaaccactcttccttttgtttttatataaataataggtagaggtctctgtacatattttatttctatgtttgtttgtttatttgtttatttattgagccttcgtcacccaggctggagtacagtagtgcaatctccagctcactgcaacctctgctttctgggttcaagggattctcattcctcagccaccagaatagctaagattacaggtgcacaccaccctgcccagctaactttttttgtatttttagtagagacaggatttcactacattggccaggctggtctcgaactcctcacctcaaggaatccccctgccttggcctcctgaagtgctgggattacaggtgtaagccaccacagctagcccatattttagtaaggaaaatgatgggtggcatgggactttgaaaactaagacgatatacttagtgttttaaaataagattttgttactgatataaaccacattgaagtgaggaagactgggtcatagtccagcaaagattgcaccttattttcttaacacgctaaagtgacaggccctatggttggtggggaagaaaggccttgtgacctagagggagaaaatgagatctttcgattcccagagtgagagagaaagatggacactgtctttagattataaaattcaaaaagcctaccgaaggggtgttgagagctacacttgaagggggctctgtattcatttagggacatttaacattacagctttctgtcatgttagcataggtcactaggtgtaaaaatggcatgataagcaatatgcgggtgttaaatgtaggagcagtatgcaagagtatacaggatagaaaaagccccttgagtccagaaagcaggcttgagtcaagagtgatagcctggactaagtggtattaaagagaataaagaggtagaacaatagaaaatagctcccaaagaaaaactaggcatacttcataaaattacagaagcagggaacaggatgacaaatgtgatctacatttgaaacctgaggactaacatgtgaagttgcctctgaagagatggtaagggaacctgtctgtgtgaggggagtggtggggaacaggacagttaatggacgcattgaacttggtgtcatctgcgtaattcaaagaaaacatgtagtggtgggtggaggaagatttggatataataagttgagtcacaggactgacgttgagtgaaggctccaggaaaaaaaaaatactaggactgacattttactgataatttacaattcttaagggggaaaaagagaaaaaaaatcaagcatagaaacaaaggaataataataggtattaggagaaaaaagaaacacgtggactaagtgagagaattttatgaaagaagggatgctgataggtttttgacaaaacgcttgggcatcaagagaatgaaaaggctttggtttgggggaaaaagtctcattggtggcttttgagaattcagttttagtagagagatggagttgttttaagaggaagtaaatggctaattgtagaagtgagctagggcaatgcccatcaggcagtctcttgaggtccagtgaaacattgaggtttagaaggcaattattgatcacattcagaatcagcttacacagaagtctgttgaacaggaagcaagtctgccaagcagggcaacatcgagtaattcctttcaaagggaatccttgcagcggcccactcagcaatctaatcagataacctaggagcactcctttggggctccaggtaacagctcaggtgcaaggagacgaaatgcacagtgggtgtgtgcaggaccttctgccataatagcctccttctaacaaggggtattcctctcataaacattccttaggcacaaaacacaccaagttacaatacttaccacatgtatggaactccaaaactacggtaccgccatcaggcattcataatttactggtatttctccaattcaagtacaatttattttttaaaatgacgctaggaaattgggagtccacagatcagcatgagcatgaataagggaccctctgtgtgaaggaagttaaggatcttttcacatggagggtgataatgaaaactttaagtgagatgactcactatagaatccaggcttcatgaaaaatatggaacttgggaaaatgtaataggttgagtgactagatcgatagtggaggttcagaggcagatggagagaggcaacagaacagattgcatcgtttcagtattgaacaaagtcttaagtacataatgagtgcaaatatttgtttgattaaaatgagtgcaaatgggagcaccaagttcaacatcttagtgtttagatgggtgacatacaaggatgatgatggtttgctaaagaagtaaataagtacaaataaaaacaatatagagacagagacgttcaaagtaatagatggcaagaaaccacaggaaatgcaaccctgttggtgaaatcactcaatcatcatggaacagtcttgagtaaaaatgaaattggttattaagtgaatttgtttttttattttatttttaaattattttttaattgatgcatagtggtacatattcatagagtacatggtgatatttcaacacatataatgtttggtgatcagatcagagtaattagcatatccagcatctgaaacatttattatttctttgcattaggagcattcaatatcttccttctagcaacttgaaactatataacaataaatatatattaactggactatctccattaatgctctatgtagccatatcagaagtccttagattttttccttcacatttttttttgcttatttacagcacaagcacgtatgattgcagcaccccctaactgttctcccgtacttgaagaaatgtccagtcccctgaatgaactcacctataactgtatgataccctctaaatccagctataaactataataatcagcttataggtgaaaaagagtcgaagatcaggggtgcaaatgaacatcgagatgatccaatgtaaactctgttttgttgatgcggaaactgaggcctggagagttaagtgacctcctaaacttgcagttcttggtaacagttgtgaacatgaattccacgtctagtgctctagactaacccatgctgtcttcaataattccagtgaaaaagcatagcagtttagtcctcccaacaccaatgcatgttcccacattcccttttctcaatctggattgttttttcctggatgagtcatatgtttctttatcaaattctaaagcttcagagtgaaagcagaggcacagccatcctatatgaataaagcagatggaagtatgggatggtttcatatggaagtctacaggtacaagtcacataactatattttaagtcagcatcttgtaatagcttccttccagtgtgcgttatgggttgtagcatgttgtggtcagaagacatgtatttaagtctgttctctctagtttatcaggtacctggctgtaggcatattcacttaacttctctgggtatcagttgaaagatcattatatctaactgtcagaatagttttgaggatgacataaggttaaaatgtataaaatcatgagacattttcctcagtacatttgttttctctttttacttttcctccaattctgctatcaaagctctggaatgtattaccaatacatctgtcatctgttaatattaatgggtcttctgtttccttaaaatacctcgataatgtataaataggaaaaatattactttatatgacaatgacatcaagaaaaagggagaaaaataagatctgagttttctaaaagaaaaatattaaataaacaatatttttaagatatatgaattcttcagagaagacaatgtttacacagggtgaaattcaaacgtaattttctgctgaacaactgtatatggaggacatttatggcaaatacaaagcagtgtttatatcatttgcatgtgtgtgtttctttgttcttaaaaaggtttcagtgaaagacaagagcatcgtcttaaaagtgaatctcaaaggttgaggctgttttgttcaaaggagtagacttcctgaggtttatgacaaatcaatgcgagggtcaaatttaaaacacctagagaagtagagaatgctgtattctttatattatccaaactattcaattaggtttttggaaaaagattgataacataaattctaggttatataggttatctccctaaatctgaataaaattctgagagtgtttagtgcttatagctgtaactgagtacattttccactatccctccctccccacaaaaggatagattggtcattgggtcagtcttgttggagacgactggcaagtcaaatggttttggaaagtaaagtggatttccgaacagaaaatgtttttccgcggaaactatggaagagatcaaggacgaaggcaaactaaaccttgaagatgaggaacggtagtgagccatatctaacaaaagctttactattcatggcttcctagtttgcaacttaacgtgaagtttgttcacatagatctgagaaaataatacctaattattgtgaaagaggacttaagagggattctttagcatggttcaggtggggctttaataagtaaaggcaaaaatatttttgtttcaggtctctaagatacatttcatgtaaaagtccataatataaaatgcaagcctatacctctgagtcaaagattcaaaagcacttttaatattatggggaaaaatttttttaaaaagccttgtagattatcttcaagggtttgaaattaattccaagcattcattagaggacaggaaaagtctgaaaatattatagtatgcatgagatgacaaatggaaattaaatgtgtactatccacactataatatttcagagaatatgaaaattaatagtgataccacagaacctgtataatttttttcctccgtgattttgtagggaatatggaattctgtgagaagaccttgtagttctcatattgtacaatgttctttgaaagcaggtgcgtatgccttgagttgtggtctcctaattatttagttgagaggtgtaaccaatggactcacctgtgtgaaaggatattggctctttatggacgcggaaattcaatgatagtgattctcaaaatgtggttcctggaccagctgcatcagtattactttacaacttgccaaaaggtaaatacttggcactcactccagaacaactgaattagaagctccaacaatcagcgttataatatgttttccagagaattccattgcagctaagttttaaaaactgtagtctctggcaaaatccgaggcacaaccagacacatctctgtccacattttacagtctctggcaattcatactgaaccacttgtaataaacatgttattcggggttcatcctaatattatgcttctagcttttgaatgatttattaaaaatatagctagtaatgcccttctaatttatcagcaatgtatccttttggtcacccattaaatcacatgagaaatgtttaaattcctgttactctggcagtggattgaaatccaggcaccgccaggttaaaggttccttgggtgattccaatgtgcagctacattttgggactacttccttactaagcaaatttctcagcttgattatgcataaaaattaccagttcaccttctgaaaacacaccctctacccccagagattctgatcagaaggtctaagatagttctaggttgttgcatttctaaatagctccacatacaattctatgttgttcagccagtgctggtaccaatatttggaagctctagagagaaaacctctcggtacttgttcttgtcaagtggtaagggatactttaaaaaaaaaaaaacctaccatgaagaacaactcacctattgcaagtttttgatctgtaggtcagagaagtgaccttttaacacaaatattatttgaatggcgttgtcaggttactttcactggggaaaaaaataaaaaatccatgaatattcagtgatacaaatggttagcagaagacaatgctaaaaatgaagggtattatgacagccaactgttttaaaacttcaagtttggagatctttgttacttagaattttgtaatctgaacaattattctgaaagattttgatggatcattagataggcaagcatctgttcaagtaaaactggttatttgctgacaaagcagaagataattaagaatcataattaactataagctagacataagtcaggattataacacttattataaccatgtataatgataaaatttctcattatattcatctaaagatttttgggtgcttaccgtgagccaggcactgtgttaggaggcaagcaaaagttacaaagaatggatgataatcttttgttataaaatgtagactgttgttcttaggaccacaattcaaagaggaagtgtaagacaaaagttcaagaagggcagtggaagtgaatgtggaacatactgaaggattttacaacacactttgaaacgtttaaaaaacctgcaatgattttacttgaatgcggaaagacagaatgctaaagctcaagcattgaaagagaactaaatacatagggtgtgttacgggctgaactgtgttcccccacaaatcatatgttgaagtcttaacccctggtaccctagaatgtgactgtatttggagacagaggctttaaataagtatctaaaacagggttgttacggtgttctctagttcggtctcactggcatccttaagaggagattaggacacagacacacacagagggaggggtatgaaaggacgcagggaggccgggcctggcgcggtggctcacgcctgtaatctcagcactttgggaggccgaggtgggcggatcacgggttcaggagatcgagaccatcctggctaacacggtgaaaccccgtctccactaaaaatacaaaaaaaattagctgggcgtggtggcgagcgcctgtagtcccagctactcaggaggctgaggcaggagaatggcatgaacccgggaggcggagcttgcagtgagccgagatcgcgccactgcactccagcctgggcgacagacagagcgagactccgtctcaaaaaaagacacagggagaaggtacccaagtacaaggaaagacgactcagaagaacccaaatgtactgacaacttggtcttggacttccagcctccagagttatggggaaataaatatctattgcttaagcacccagtctgtgtattttgctatgacagccccagaaaactaatacagatagtaacttgctgtagacactgtctacagagtaacaaacataggcaattaactgaacatgggaacaagacttagttggccaaaggtggtggtgcttgcctccaatcccagcactttgggaaactgaggcaggtggattgctttggcccaggagtttaagaccagcctgggcaatatggcaaaacctcatctctacaaaaagtgcaaaaggttagccaggcatggtagtgtggtgatacatgcctgtggtcccagctactctaccctgaaggctgaagtgggaggatagcttcagcccgggaagcagaggttgcagtgagctgtgatcatgccgctgtcctccagcctgggtgacagagggagaccctgcctgggagaaaaataaaaattaaaaaaaaaaagtcacttctgactatagggattatctgggagtctgcaaggtcttctaaaaggtgatattttaaatttaaaaagttacctatttttaactcctggtagaagtaaacattgttcttccttgaaaacataaacaaaacaacacgaacatctcagtattgatttgtcatctccttttggaccagatcaaagatctgcctgagataatttgacttatacataatattaaatggtattagagtgaggttacagtatatgatttcagtgtcttttatctcttacatactgtgttctctacccggaaggagtgaagcagactgaggggtcacgtggtcctatagtatagaaatcatatgtagaaattgattcagctctgatgcatacatatggatggataccttgatatttaaatgggacctctgtctcatttctccatctccctaaataattaaaaatcagttcactcttccgggaatcattttgaatgaattgaagagtaatttgcaaagcaagacgtataggggaaagagcatgcatgtgtgtttgagtctatggggacatcgcatttggcatgaggtgctcaggattcagaggactgtcttgcattttcctagcagtcagtggaggccttagcattccaacctaggaagctctatagatgtaagcaatgtgtttgctttatttgactgctatttatatgacagtgacaaacagatatggggtaaacttactgttttgaaaaggtcagacaaaggcaaggaaaatagaagcaaatgaagtgaacgcatgaaaaatgattactcaaagaaagatacaattatgcagagcctgaaatcaactcttggtttaatgttgtgatatgagtctctcaagagaggacagcaatccaaaaccatttccccagagaagcatggaattttacagttagatatttatttattgtgggaagtatttttaaacatctttcaaaatgcaaatacttagtgtcaatgtgtttttagaccctcctctgtgaaagagatacgtagaatggtagaacaaggtaagagtctaaggggaagtgggataaaatttcaggaagtgaggggttgtgaatagtctgaaatggagtatctgagctgcaggaggagcagcagccacttactggtccctgcgggcctgtgcccactagggcatatcaaaccctctgatggagctgctccaggctagcctcgtcaagccatctcccagcctcaggccgaggagatgcctgacggggccagcctggagcagctgcatcagaaccctacagctgttaagaacctttataccagcagccacaataacaccaaggtcacacaagatttcaagcaatggaggatgcagcaagacaggtgatagcatcagtgaaaactttaaatgagctacaaatgttaacagtgttcccctgcttaatttactgttttcctaaacagctatgaactatttgaggtgaagctcaaaaggacatactgaggtccaggaaattgaggtcaagctgcattttccagacagaggtttcaaatcctacatgaggaggaaggttatttacatattaagccttctgcgaagttcaataggtagactcttgagaaggcaagtcttgatttgtagaaagggctccatctcttaggcacctgagacccaggtcacccttagcgttgctcaggttgtacttcagaaggactcccaggtaagggaggagtgagagttaaattctagctcctgacaagcagggctgtgggtacccagaagatggatcactacttctttatatgcacaaagattttttttaattttattgtattttaagttctcggatacatgtgcaggacgtgcaggtttgttacacagataaacgtgtgccatggggcagcagccatcactgtagctccaggccaccattttttcctctgctggtgctggggagactggatggcttggtcccaagaggtagttcctacatttcagcacaccagctgtggaagatcgtggcccaactgcctctttaggacagactctgacccatccctcctcactgagtgggccctccctgcaggaactccagcaactccagccaggggcttagggaccaaactctgatcttcctgggcctgagcccctagtgggaggggcagctgtgatctccgtggatcagtagatttagtctcttctcctgctagctctgaggaatccggacagctcagacgagtgggtttcccccgagcacagcacactccctccaccaaaggacagtcaaagtgctttgttaaatgggtcctggatcccgtgccgccctgactgggtgagacttcccaacagaggtcaccagacaccttatccaggagcattcctactggcatccggtcggtgccccttgaggacagagatcccagaggaaggagcaggaagccatctttgcctccttaggtgacatctccaagtgtgggagggacccaggtgaatagtctgaagtgaacccccagcaaaccacagcacccctacagaggagggacctgactattgaaagaaaaacaaaacaacagcatcaacaaaaaagtccccacaaaaacctcatccaaaggtcagcaacctcaaagatctgaaccagacaaactcatgaagatgagaaagaatcaaccaaaaaaatgctgaacactcaaaaggccagagtgcctcttctccaaacaatcacaatacctctccagcaaggacacagaactgggtggatgatgagatggatgaattaacagatgtaggcttcagaaggtgagtaataactgttgagctaaagaagcatgttctaacccaataccaaaaagctaaggaccacgataaaaggctacaggagctgctaactagaataaccagttgagagagaaacataaaagaccggatggagctgaaaaacatagcacaaagatattttaaatgtaccaagtcatacagccattgagaccacatctttttaagtttttaatttgcaaaaagttgtagaggcagcccctatctccctttgtggtgtatcagcctcagggatcttggcaggtggaccagcattgggatctttcacagcataatttatctccatgcttctggtgctctgagtatctggatggtctgagactattactatgaagaacaaagtcatgataaggtatttctgcagcctaagaaaactgcagcattctgttcactgagaaatttgtgcttccataaaaaatgattttaaaaccctatctattattgcagtgaataaaatgagattttgagcctattgttggatttaatcattatttttatggcagaactggggttgtgggagtagttataaccagttgtgttcttttaatctcttttattaagtcatttatcataagtaaaattcagtttctgaccttggtgctttatttaagtttccaacttatctgtttcttagcatgttttgtgttcccattttaagtctgtaagggttatagaatacttatttcattttctctataagaaactgtttagcaatctaggatagtgttatgattaaatggcaaaaagaagagataatgtcaaaattaaagctacttaacagtaaggggcatggaaggctacatatcaaacccatctacactcaagcttcattttcaataggggattttctatggcctcttggctttcttgcttagcttaatccaagatttctgattatcaggacaagagaagagacaaagggtgaacacaaaaagtcatttagaataaatgtatgtcatatgatagtccaaattaaatgcttttggtattgctgtatccatattcctttaggttacatccattgattctttttacatctatctgcattgcatagccctgtaatacttaaaaaatttcaaacagagtaatgaaaagcatggaaattcaaaagacaacagtgaaagtaatggaaaacagtattaataatgtccagtggttgaatggcaatgagtgatactcaacgattgaggagtgaataagattaattaatttaactttgatggtgatgtcctctcctagaatcttgtttcctttcatgtttttggtacgcatccttcctctctctgatgttctgtttcaaaatttaccctcactattaagcttttcctattatgccaaccaaggttaacacatttttttttttctgaattcctataatagtgctgctatccacgcaactatggacttggtgagggcaggaataagatcagtttgcatcccatcagacccctagcactgttagcatagaattgggattcacttgtttgttgaataaataaatgtctggataaataattgccataaaatttgtacttaattttcatagtactctcataaaactgatatgtgttgagtgtgttttcgattataaaaatcttgaagagaggatcagtgactttcagctcttcattttcctaccctgacaatcctcagttctaactattgagattaacctcatgaagtagagtacaaggtacccaagggaagtctggagtagtccctgtgacatttctggtcttcacagaatggtgtttgtggttgtggtgagaagcagtggaaggttcctcccacacacatggtctttcacttttccctgaaatctggcacccttgacctgcttgtaacctactttgtgctgacccattcaccttaataagaaaggtaaatatataagcattacagtccaaatattttttgaatttttataaatggtgtttaatgctatgagattagaatgaatctaccatttgtagacatttattaaatgtctactatctaaaaatttaaatgtatgtacatcctcttttttgacactcattcgacactcattcacttcaatgtttttaaatatacatacagataatgaccaaatttatatcttgctgcactgacttctaaactctatgcagccatgaaaaaggatgagttcatgtcctttgcaggaacatggatgaagctggaaaccatcattttcagcaaactaacacaggaaggaaacaccacgtgttctcacgcataagtgggagttgaataatgagaacacatggacacagggaggggaacatcatacaccggggcctgttgcagggtgtggggtaggggagggatcgcgtaaggagaaatacctaatgtagatgacagattgatggctgcagcaaaccaccatggcacatgtatacctatgtaacaaagctgcatgttctgcacatgtatcctagaactgacagcattataatgataataaaaaaaataatggagatagcattagggatgtcagaaggagagcaagtttgatttcagatacactgagtttttaatgtcataagagatttaaactatacagtccaaatttttggagaaggattgagattttgttttcctattacacagaagaatcgaaaatgaaagattttattttctcagcatggatgcatccaggttttgtgtagctgaaagctttatacaaattggaggtaggggacctcttgatacaaaactacaaataaagtactaaatggagtctttatttaatgaaaaaacccataacaaatatttggagccttggatgctcgagtctctaattttttaagatgtcaagtgctttactagaaatacttacaatgttatgatgaaatgcttcctgagtgtaacctggcttcccttccttagacgagaactcctagaactcacgggtcctgaatctaaagcttaattcaccttgcagtaaattctcctctgtttggtccttgaggattgataaagacttattttgtgtgtgtatatgaccataagatatttcaaaatgcacttttatttcttctttttatgtatctagggtaacttttaggttaagaaaatgttttatttaggcttttctaattgcaaaaaacaaagattctctcaagctatttcagcagagggaaggctcagttcaggagctgagaaagtgttcacccactcaacataaccatgttggatatataatgcaatccagaccctgtaacatacagacacagcaccttctatcaaggagaaggagtgacttagaatcatcatcacataaatacatgtgcaaccgactgcaatagtgctatgagagacacaatatgccgagcacatatgacaaggaaacaaaccaggtcccctgggttttgtttacatgtttgctatattcctcttgtttttgatgatattgctggaggagacagaagggccaggacaatcaagattttcccgagcaaggattatttgagctgagatttatgtatggataggtatttgctaggcaaaagtagtagagatgagggatatgaggtttcaggccatggagttaagagacaagactagcttgttacaatggctcatacctgtaatcctagctacttggaggctgaggcaggaggattccaggaggccatgagttccagaccagcctggatattatggtaagaccactgtctctaaaaaatatttttaaattaaaaaatgagttgggtttcgtggcgtgctcctatagtcccagctattcaggaggctgagatggaagaatagcttgagcctaggattctgaggctgcagtgagctatgattgtgccactgcactccagcctgggcaacagagtgataccttatcacttaaaaaaaaattaaaaagaagaatgaaaacacaatacgcaacataacatggtgactcaaacctaaggttgatttagaattcgcaatagtttcaatgaaagcaaaaagtcatgagtcatgtctcttctttctatatctattctgtctagttcatgagtactggccacaggtgcctatgaacccttgaaacacagcattccagattgagatgagcttccattgtgaaatactcagtatgtatttgtatgtacatagtttgtaaaaggctttgtatgacaaaaaaggatgcaggatatctcattacaaactttcatattgcttgcatgttacaataataatactttggatattgggtaaaatagatacgaaaattaagtcgctggttactttatccttttattaaatgtggctactagaaaatttaaaattacacatgtggcttacctctgtggctcccattatatttctattggacattgctatttgagcaatgactcttagccctggctgtatgtacatcgccacccaccaggccacacaatagacctagggtagtagaatctcttagggcatctgcattttagacaaatgacctcatttgttactaatgattgtcacacaggtgttccacaggctgttcctgtaaatgccatggctcagatgtgtgtattatacattgtttctgcttctttcagcccttaagcctctggtaagctgtctctttgaatctagtcagagtccaggaatcttttcctgctagcatagcctcatgtgcgaaataagttgtgttgattcatttgccattaggacgactgtggtggcagcctccactctggatttactctgtagggattcgtaagtcatttttagtccatgactcttctcttccccctaggaagcccccaccagagacaaaactagagccgctttttatacctgatttttcggaagtcagcttcagaatggatttgtagaaaatcttgtatctctaccagctcattacactttgggtaacgttattgaacgtagaatttaagtttttaaaacagaaatgtaagtagtttcacgaaagaacaacttgtatagatcatgataacacctcgttaaattgaatagatccttgtcttagctgctaagtaagttgatattcctttaaaataccattcatttgagaagcagcaggaataagtgtagttttttcctctctccattgaactccagcttcatgagattatttattttattaaataaattcaagcaacctctaaaatgttctcaatttttgcagcatgatgtctaatgtctttatatggagtgtaaaaactctcacagtctggtccaagtccagtcttgttccccagttctccctctgctccagacaccctgaatgccagccaaactgcactacacattatccctaatgcatgctctgtgtattagtctgttttcacactgctggtaaaaacgtacctgagactgggtaatttataaagaaaaagaggcttaatggacttatagttctatgtggctggggaggcctcacaatcctgatggaaggcgaaaagcatgtctgacatggtggcagggaaagagggaatgagagctaagtgaaaagagaaaccccttataaaaccatcagatctcatgagacttattcacttccacaagaacagtataggggaaccacccccatgattcagcgatctcctaccgggtgcctcctataacacttggaattttgggagctacagttcaaaatgacatttgggtggggacatagccaaatgatatcactctgcttcttcaaatctctagtaatttgaaattattatcattattactacttttgagatggagtttcactcttgttgcccaggctggagtgctatggcgcagtcttggctcactgcaacctccacctcctgggttcaagcaattctcatgcctcagcctcccaagtagctaggattactggtgcccaccaccaaacccagttaatttttatatttttagtagagatggggtctcaccatgttggccaggctgctctcgaactcctgacttcaggtaatctgcctgccttggcctcccaaagtgctagaattacaggcatagccactgcacctggccttgtaatatgaaattagattgctcatcctagaatcttgtaacccttctccataacaaacttctactcatcctctcttctgacaccttccttcccgactcccttacataatgttagtttgccaaactctacttcagtactaaactctaaaggaatttatttgcatgtatacgtatttttcacaagtaagcactagagcacaaggttgaagttcattacatacctgtctttgatgggtagaaagagcagattatttgaagacgttactgtatctctaccttcagcctatgcttttctcttgccatgtattccagtttctattttttcgagacagagtccggctctgtcgcccaggctggagtgcagtggcgccatctcggctcactgcaagctccgcctcccgggttcacgccattctcctgcctcagcctctcgagtagctgggactacaggcgccgccaccacgcccggctaattttttttttttttttgtatttgtagtggagatggggtttcaccgtgttagccaggatgctctcgatctcctgacatcatgatccacccgccttggcctcctaaagtgctgggattacaggcgtgagccactgcgcctggccatgtattccagtttctttaagcttcctatatacagtgtgatttaaatctacttatcatctggatgatttgtcttttaatatacttccatttgcttatgttgagtgaagttatctgaggttagaataacgtacataaaatgatatgtgaattgtaggccttggagagaagtcttaaggacactcctgtttttagctattcttcttttccatttgctgctgtggactgtggtttattttagactaaggaagggcatggtgcggggtttccactgctgcttaaactggagttgaaatcctatgttctgcttcctggcccactcccagcctgcagaagcccccagcactgaggacaatctaaacgggcgggattgaattcaccttatcaccacttcgcgccgaaatttacagtctacgttgaggggttctgggttttgtttgtgttgtttaaattgttgtggtattgatattactgttttaaaattaataattatggtagcatgctttggttttgaagcttcaggttgtatatactgaagagcaacatctttaatttttattatttttattttagattcagagggtacatgtgcaggcttgttacctggatatatttatgtaatggtgaaatttgggctactagggcacccatcacccgaatagtgatcattgtatccaacagtaatttttcaaccttcacccgctctgacccaccccactttggagtccccggtatctataatttccatctatatgttcatgtgtgtctattgttgaactctcacttataagtaagaacatgaagtatttgattttctatttctgagttatttgtcttaggataatggcctccagctcaatccatgttgcaaaatacattatttaatccttttttatggctacatagtatttcatcattttatatatgtaatatatattttatatatgtaatatatattttatacatatatatttatatctattttatatatatttttatatctatacatatatattttatgtataaaaatgtaatatttaaacatatataaatatatatgtaatatatgtatattatatatttatatgtgtaattatatattacgtattttatatatttcatatatatgtaatatctattttatgtaatatattacataacatatattacatgtatgttatgtagtatatattacatattacatatatacacacatatatataatatatacacacacagacacacacacaaacacagagacacaaacatcttcttttcctagtcatctgttgatacacacttaggttgactccatgactttgctattgcaaatagtgctgtgatcaacatatgagtgttgggtagatacacagtagtgggatggctggatcgaatggtagttttacatctttgagaggtctccgtattgttttccatagaagttgtactaatttaatttcccaccaatgttatataagcattcccttttctccgcatccttaccaatatctgatgtttttgactttttagtaatagccattctgacttgtataagatgatcatcattgattttgatcatctcattgaggcttcaatttgcatttctctgatgaatactgatgttgagcacatttttatatgtttattggccacttgtatgacttttgataaatgtctgttcatgtcctttgcccactttttaatttttttgttgttgttgttgtttaatgaagttgttctttgagttctttgtagattctggacgttagtcctttgtcagatgcataatttgcaaatattttcttccattctgtaggttgtctgtttattctgttgtttatttcttttggtgtgcagaaactttttagtttaattgcatgttatttgtctatttttgggtttgttgcattttctttgaggttttcatcataaattctttccctagaccaatgttcagaagaatttttcctaggatatttcatgtttttttaatagtttcaggtcttacattcaagtttttaatctatcttgtgataatttttgtatatagtgagaggtatgagtccagtttttttaggcatatggctctccaattttctcaacaccatttattgaataggatgtccttttcccattgtttatttatgttgattttgtcacagatctcttggttgtgtgtggctttatttctgaatcctgttctattgatctgtgtgtctatttttataccaataccatgctgttttggttattatagccttacagtataatttgaaatcagataatgtgatgctccttgcttcgttccttgtgcttaggattactttggctcttcgagctcttttttggttccatatgaaatttagaatttttttttcttattgtgtgaaaaatgacattagcaatttgataggaattgcattaaatctgtagattgctttggggcagtatagtcattttaacaatattgattcttccaatccatgagcatgggatgtttttttcttttgtttgtcttctatggtttctttcagcagtgctttgtagttcttgtaaagatctttcacctccttggctaaacatattcctagatagtgtgcttgtgtatgtttgtgtgtgtgtgtgtgtgtgtggctattgtaagtgaaattgagttcttgatttggttctcagctcgaatgctattggtgtatagaaatgatactgatttttatacattgattttgtatcctgaaaccttactgaagtcatttaccaaggctagggatcttttgaagggacctttaagatcatgtcatcagtgaacagagataatttaacaattccttttcctgtttggatgccttttacttatttctcttgcctaagtgccctggcaaggacttctagtactatcttggaaagtcgtattgagggtgggcatccttgtcttgctctagtttcttaggggaaatgctttcaacttttcctcattcagtgtgatgttggctgtgagtttgtcatttatcactcttactattttgaggtatgttccttcaatccgtagtttgttgagagttgttatcataaaggcatgttggattttgagtgctttttctgcacctattgagttgatcatatgggtttttttttaattgtttatgtggtgaatcacatttactggtttgcataggttgaaccatcctttgattactggaataaaacccccttgattgtgatggatcatctttgtatatgctcttggatttggcttgctagtcttttgttgaggatttttgcatgtgtgtttttgcatgcaatatcccagcatcagggatgttgacttgtatttttctttttttgttgtgcccttgcctggttttggtatcagagtgatactagtttcatagaattagttaggaaagaatgcctcctccttaattttttttttttggaatagtttcaataggatcgataccagctcatcttcattcatctggtaaaattcagctgtgagtccatctggtcctgggctttttgttgttcttggaagattttttgttactgatttaatttcaagcaaaatcttttaagaaagaattgtaaaatatacatatctaagcccaattaagaccaataaaatgtttgtaagttgaattaaatagtttctctttattcctggtacagtttaaattgccacttgtcttgaagtaaccattgtctcagctatgttacagataccatagcttgtaaaaataaacaaatgaatttgatgccaaacttgaagctcatattggaatgtaatggttttaatgcagacacaatttctttctgtatcctgattagattgaagcattgttttctactgtaacagcataatatttcatcaaaacatacctgtgtttgagagctcataaggtcttcttgtatattgggaacagatatggcaatattaatgactatgttaggttttttatactagcacactttcatatatgtatttgtatttataagaaatttttctttcaaatgctgcgttcaattgacaaaaaaaaaactgcaaatgaagcacagatgctgtgaattggaatacaatgtgcaatgcaatttagccctgtaggctttctggaaagaacccacttcccctatgatgagtagagttgtcagtagtgacaataatgctgttagacgtgaaaaccaagtgtgctcacctatgattgactgacaaagccacggtgcctccatgaataaaatccaagtgctgcgttacaattcatctcatgatttttgtggttcagtaatttatctttataaaacaccaatgacagctagtattccgttgttcctgtgagtgaaatatgatatgcttgcaatatggtttgaggattcactaactatggctatgtacacataatttgtaatcaagttcatgcatgagtagctgaaatataaataggaacatttaagactgtctcaaaactagattgaattctccatttacgtagtcatagcaggatggttcaggtacatgtcataatgagcctttgatgaatgtttgagacattcagaaaaggagtagaagccaaatgagaaccaaaaagaaaagaaaaacagaagaaccatagcattacaaagctaaagactagataaacttaatttttcagaagcaaatcacataatgaaacaccaaaatgagaattaaaaagtcagaatttactactatttgaactcctgagtttagccattttttctctgattttccaatgttgaatggagataattcaggttgctaagtataatattgaatatatatttaccttagaaatttgcacatatacattataagcatatttgtggggatgctgtacactagaaagtaccatgatttactcgtattatagtctatagctgctatattcatcctcccaagaaatctgttattatgccatttcttccgtctataaagttcttactagattaagttcaaacttctttttttttttacttttcataaactttattgatagtggccacaataatttttccttttctttctttttaagtaaacaacatttaaaagataatagtaaatgaattcaaacttcttaatttgaaattcgaagtccttcatcatctggtttcaactggtacctctggtcttatcactcattccataccatgaaatgcatgcaaattgctcttgctgaattatacataatccacttgctcattcagcaaacatatattgagtatgaacaactctgtgggtttaaagatagaaatatgctgctaatggatattcatttatatattctaggagctcaggaaggggtggaaaccatgcaaaaaaaaaaaaaaaaatagcctcctacacttccatcccttaattcttgacaatctcttcatttcaggtagcttttccatcaatttccataaatagaaacttttccatgaagtcttccctatatcctcaaaagaaagtaatccatccattccatagttcatagtgatttcttttaatattaagcaatgttcactgacttttatagttacttctctacatatgtcttccataaatcagtaagtacctcagaagttgaggaccatgtttcaaatattttctctatcatccacagtcttcagaatttgtaactacagaacaatctgttgaatgagtaaaatcatggaagtatagttggggacaaaattattcttatttctttcttaatttacctccttaaagatgtaaaagaaaaaagtctaatttctctcatctatgactgcagtgggtgtaaaatcaaaccatttaattattaaaatgaaaaatagcacatttttaaaagattcacagtacattttgtgaagttttatactgaataaagttttttataaggaaaaataaagcataattattggaaataaataaaagcgtgataattgtctccattatatagctataaaattttatgtctatcattaatcccttataattatttaaaattatttcagtcttttcgtataatgttaagtaataaaacttgcataattatttttaaaagtctaaaaattataaataacatttataattctgcatctgtgataggattttataactgtacttgtaacaaaatggagcttacatttttaaatgtaaaattgaatgaatacaaattactttctatcctgaatacagagcattatacatagcttgctagacatagccaaaaatacatacttgaaatcattataatgaagatgattaaataactataatcattctgaaccctatctttatgatattatgccaaatgtgttagtaatacttacctacattttgacatgttataatctacataaatttactagtgatagatatacttggatttcagataatgcactaaaattttctgcatataataaatatttttataaatgtattatttcttccagttaaaaataatcatctctaaagaaaaagtaaaatataatgctataatttcttgatcaggctaatggtgagacgattattcattcttaaagctttgactcagagataataaatcttgctgagaaagacgtttgaattcattatttctcataataaatgctcagtaaatatttgatgaacttaggcgatgggtccccatagttttattgtcagtactcttcatgtttatgccaataggacctaataatcatataaactacattttcatctagcatctgatttccataaaatgataactttgtcttcttcagtatcatctcattgtcttgacatagtaagagctaaattataatattgattattattaagtgcctagttaaagaaggaaggaaatcatcctagtcagtttccttatgttgcttcataaacctatccctagatgatccaccagcttactatacaccaggcattgttagaattctcgtcagctctcaatggctcccttttgtcacaaagtcaacattgacttgaaccaatgtaaacgctaaatactttaagaatgaaataactatatgattcctgtcttgaggtaacttcatcgatcacagtagaaaatggtaagtttacaagatgctaagtagggatttattaggatgtttacacggtggtagacagagatctgtcagataggtggacggcctaaataaaagcatgagatttgttcttaaattctgtctgcagagcacagtgaacaattcaagtctacatgtaaagtgatcttacagtgacttacaatggactctttctgccttttgtatagtacaaatgatgtttgttttccaaatgtatacagctaattgtaaactctttcttgtgtaaccataacttttgtttgagccaagacattaccagagtgggaaagccgctgtttaaacaaagaagaaaatcaacagtgaaaagaggtgtctagtgaccaatttctgtttgcttgagttccctttgagaacgggctgggaataaataaattaaacaactgaggcttttacaggaaaacaataacaaaagcccttttctgtctttgcacagttcagagacaaaaacagaggtcacacatcctccagcaagtctgcttcatattcaggcgtctcttacagggacgaaaaaatctctcgtagaagtcatgctcaataaaatgcaaactcgtttacgaaaatgccaacattttcattttcttttgatgactttctcagagaataatgatgttcagcttagggttttttattttatttttatttgtagtgccctttgggaaagaacattttctcttttaaaagccacacaaagtttaactcaagcagtctcattgttctttctcccacaaagctagcaagaaagactaatgtattacttaatgaagctattcattgcttaataaaaataagaattagtaacaataactgttatattcacattaaccttacttttatgctttaacatagaaattgttctgatgtactatatttctaccataatttgctttaaaaaataaagcgagtgggaagtataaatcccatgatatgaaaagtaagatatccttttcattgttattgtagaaatctgagttaataacctgtgctaaacccagctaacaaaatctcaagttttggaaagtgcagagttgtaatactgatgataagtggcagctctgaaaagtgaaaaaaaatctttgacttgaatttcacaaacttgggtcttactaccaggttttcaacttactagtttatatgggcaagtctcttaaattttttgaatctcgatttaatcatctgttcattttcaaaatgggaagtaactctggctgttacacagaatggtcacttattaaatttttgatgttcacatataacttaaaagaaagttcatatgtaactttaaagaaggctatatgtgaacattacaaataatgataaggaccaatataataaacctctggtgcaagatttttataacgaatcatcagcattcaatataggaaggctgcaacattgctcatagatatctcccttgaaataggtaaattcaccagatttacaaaatggattagccaaaagcttatattaaatattatttttaaaagacaatatgtatattaagaattgatgctctgtgaggtcagtaactttatttttgatgtagtcatattgtctagggtattgtctgacatagtattgaataattgaatgaaagaattccctgaatatactttcctttagtatattcacaggctgatttagttcataactacaatcctcatgaatatgttcttcatgaatatatttattaaaagactaaacctatgacccttagcttttgataaattaaataatccctacaatactactaatatattcacatttattggatatatttaagagaaatatattcatgaatatattcataagatgaatacattcatattcatagaatatattcaagaagaatatttcttaacacaattacctaataaattggtaaaattgatgaatttggtgagttagtcatcacctgattctttagataattgtttttggccaatccactcttagagaattggttttcactgaattgatctagagacccttcccttgactatgacctgtgtgatcatcagcaggtagctactagctactggagtttaccaccctctacacctgtgagctgagatcaccttctgtgaaactgctgttgggggatagacaggacctccatcttccaaaaggagggaggttagaagccaatgtcttcttcagaccaagagtgacttaattcgctcatccggcttactgtttcaaattcttctccctaaattctgtgccttcttagtcctccttgttcttcagaggctacggctttaccttggggagatttgatagtgggcatgaaaccttagtacaacttgttaaaggctgagctagacacaaaggggacactctaatttagctattagtctaagtgtgtaatccatataaatcaggtgtgaccagccacatgaaactcctttctcaaataatgtatatttagtttttcaaacttgacttatatccccagctaccaaagaacttagcttctccaggaaagtcactgtcattgtgagccatggtttggatgacatcatcatctctcaaatatgtgagagcagagtgaagattgagaatcttcaagctaatttaagccatgacagtggtgagatttcaagagttaaacattaggctatttgaaccatctggttatactttttagtctaaggcatacagagatggtgaatttaagaagaatgaagatgaggaaagcctgagaaaatttaaatacagggaagatgatggactctctacagtttaaagggaaagcaaaacaaaatggtgcttaattttatattatgtatctgtgtgtcataaaagagccttaatcatggttgataattaatcaaaggaaagccctttatttttattattaatttattactattactattatttatatgtagagaaagatgggggtctcactctgttgtccaagctggtcttgaactcctagtctcaagcaactttcctgctttggcctcccaaaatgctgggattacagatatgaaccacttcacccagccaccattaagtttacaaatgaaattagacataatttgaaagtgatatcaacttgaaaacccttaaaagtgtcctgaagtcaccttcaaaaattttatgaagacattgtctactatgccatagtccaccaataatttcttcttatacactgcagttcacatgacattaatggcattgatagctatcagttttgctaaattataatatattaatatcctacaactatatgcatatttcatgagttttttgacacatctatacccccatctaatgagttttaaagataacagtgactccaatattttccacattttaaggtatttttatgttgtacattaaatatattcttgccctgatttattattttattttgttgacatatacatatggaaaaagtccatattatgattgtatagttcaaaggcttttttttaaaaaaaactgaacatacctatgtaactagtgtctatatcaagaaatagaatgttaccaaccctccagattgcttttagtttcaataattcattttaactagagggatgctcatctagcaaccaactttaagcaatacgcagcaagtagctaccaaaaacaatataattgtgctatataataaaaaaagattatctgtggatctagctaatgttgtctttagataggacatgttctataaataagaaaatgataattactcatttgtatcatagaagtttaacattatatgtcatctaacctaccagaaattctctcacataattgcctttgtggggtattgctggatgacatcttcatcctaatattagtattccagagaatttctgaaatagagaacaaatgcttttcccaaaaatcttacttctatcttcaatttcccagtactttctgggactctacaacttggcgttaaatcacagaagtggctatgaattccctttcagattttacctggtaaaagatcttagttctttctatggtcctggtttcatcttccatattggtatgtcatttatttattcccaagattctatgacgttaccaggacttcccatcttccctttactaagatacaatattcaagtgacgagtcctacattttccacatgtaattttcttttttcatctcggtgaaatctctttcatctctgtaggtgttccatggccattgtgtttaatgtttagagtcatccagaacggcaagtacaaatgtgaagccaaaagttttcaacttcaattatataagtatttattttaatgtgccctaaataacgtgtttttttccccccaaatcaatacatcatcattggtctttctattcctctctatggcacatgaatgtattctagtcttttttttaagtagttagcatgaaaaggaatcttgtaattcagctggaatgaagcgttcattttagtgataaaaatttggaggacagagagagaaagcaacttcttcacataatattacagtacatgctgcccaaattctaacccaactctattttagtatatcacacggctctcctgtcttacgtagcatgtaatgaatatcacatatgtgtgcatacacatatacaagcacacatacctgacttatgcacatgatgccaacccatgaaaccatattaataacaaatcaatatttttaaaatttatgctaggataaaaatattacattttaaaatatttttatttttaaccattaatcaaatgcctatcacatttagtttataatccacaaaaagacttggtaacatacatttatatcctaatatgtgttacttcactcacataaatactgttttaacgtactcacctatggcatttttccacacaagttttgccactaggagtaagaaaaactaccaaaagggcagttgacactcaaaaaagattattgttgaattgaagatttctgaagagacatagttaatgaataccttgagaggtacctttcaaggttcagtcctcattaatggtttaattggaggaaatgacattgagctgaaacatacagaagctgctaggagtcatgtagaagaataagtagtagagaggttggcaggaaaaacctacctgtaaaaggtaagcactgagtttttgcctatatctgcagcctgggtgcatcctttgaataaaagttaaagattatctggtggcatgtataaaaacagagttttataaaaaaaggattaatgcagaattatctgaaataagaaactctattcttattatgcaatttataaagcaatttaagaataattgtttctattcaaatcataaaggattgtacctggatgtaatattttaagatgtcttttccttgtcaggattctgatcatgatgatttcctgaacttgggaatttctgagcccctgagtgactggataacctctctaacttaaaaacaattatctcactcgtgttacccagtaaacacaggtataaaaaggctctattttaatgaaagccactaaaattcaagttctttatgattattatggaaccaaaattttgaaatatttcaaagaatagaattaatcatacatactattttaaaggaagccattaaattacatttctgacaatttttcattttaagcttttgttataaacatttagaaaaaatgagaaaattgattcaagaattaaccttgtctaaattgtcattattttcatttttgatattcctattattcctttttaaaaatactttttgcattgcatctataatactaatatgacagaatttaaaaagtcattgaccaatagcattacataatttcttccttaatacataagaggacaggaactatgtgcctttgggacatggagaagaggcaaggtgctctgtaatcattctagtgttcatttctctaacaggataacaccagccttgaagacgggaccaatagagttttaatggcatattacaattaggatatggaaaacaagagaatgcctatatttgggatgacttcttgtcagattcccagttggataccaaactaatctcagctacactctgtcttccccatttatttttatttattcttccaaagctatgtaactctgatttgtaaaatatagagaagcgttttctagaaattataaatatgtacataaagctatttacatatcattagaccatacagttgggcaaactccataaagtctggaatcatcagatttatttttatattgtctacaatgtgtcaaatagatatatcctcagaaaaagtcagaggaattgatttgaatgtccttgccgtttacatagtgtcaattttctataaaccaaggatgattttgtgcctttatagaaaactaagatattacatttatctgaaacatatatgggacaaaaataaaggtctaaaaataacttagtcaatttagatttaagaaattgtaataataataatgaaaacttatattcctaaaatgatacaataacaatcttatcactacaaatctctgcttagaacagaacaaaacagtgactgtaaacaaatactaatatttaatttaaaaaattaacttggatatttattttaaaaagctaaggaacaggaaatataacctataaatgtttaaatagaaaaaacggaacgtaagaaaaataatctgaaaagcataaatgaaatgataatatatgcattacccaataaagtcaaatggtgcaattaaagaatgatgaattatataaaccagggttctgaacctgagagaagacctaaaccactgaaagtgcatacaaatttggggtatatatgaatgagtttttcttggatcaggattcatagttttcattagcttctcaatatacaccactattcaaagttcttctcctttatagctaaactactcgagggtcatatcttccctttccattcacctaccatattctcccctttccactccaatcaacattctccttcacattctcaaatctaatgttcacttctcctccttgttttacttgatgtctcagatgcacttataagagttgactagtccctgcttcttcaaatagtttccttcttcacatcacattctcctattcttttactggccactctctcagtaatctttctttgttaaagaaaaaaaaatattcagtgacacttgttacggcatggtgagaaatattttattcagtgccatctcaatgggtatggggaccacagcaatgggattttgcagtggcggagactacgctcaacttcaaatatagcacgggcaagtgggaatttatatagccaaagaatagagtggggtcagtggatgcaacattactaagaagaaacatcaggtgcaaacaggattctggttaaactgtcctaacaggattctcactgaaaacaagctggggtgatccaccatcccccgggagatggcgaaggatgaggaacctgatcagatatcatcggggtaattagatatggaaaatcagagcagggggagtaggaatgggggtgtgtcttgctaaactgacttagcagggttctttgctaagctgaattgtataaggaattgcacagatgggccttggagaaacttcaggagcttaactaaagtttagtcaagcaaagaatctctgctacctggcctctcatccatttcctcaactttgaaaatttagagtactccaaggttcagcctaaactctcttttctgtgtcaagtctctccccaggtaacttcatcttgccccgtgacttacactcatgacatacgatttgtatctccagactacatttttttcttgagctccagacccaaatatataactgcctacctgatatctctacttggtgatctaacagattcgcccaacctcgactccctcccccagtctctcattacagttaaatggcatcaatttccactcagttgcttaagttacagatctatttctcaaactttcgacagccagtcaatgacccaccagttgtgcttccaaaacgtgaaaaatctggccacatttctccagtgctaacctccgtccaaacttccatcgtctcttgccctaatgacggtaagagcatcctaatagatgtccttaccttcactcttgccttctacttatcaggcctttacctatatattttctcttatttcctcagtccttcccccttaccttttgcactctggtccctttggtctggcactccaatacaccaagcatattttctctcagggcctttgcatcaaatcatcatgtggctgacctcttgttgtccttcaggcttcagatttactgtcacctcctcagagcattacccttttgtcaatcattcttatctctctattacaatctctgttttagttattttatagcagttatcactgtctgaaattgtacctgtaaacccattgtctgtctttgcacacaagaatataagctccctgagggcaggggccttgtgtgtcttctttactcttatacccctggcacctcaaactatgccagttgcattgtaagagatgaattaatgagtgaataaatgagtgaaagaatgagcttgactctttgaaggagaactgtaaaagggcttaagctggtgggagcaaatttacacgttcctctctttagagaacagctgaaaagttaagatgaaaagcaaagactgtcaaatcaccccagtcataagaaatcagagaaagcagacgatgatcatcacgtgcttcttcctgttttttaacctttcttcagttatcaaagtaacgagagtagtttgcagttactcatggccaaagccagatgaaatacaacagatattaagtgtgacatctcttcatgatatgaatattttctctgttatacttttttgggttttccaagttttttccaataaatgtcactttatggatgaagaattgtattctttaaaagtctgtatttaaaacctgaaacccatctcaaatgccactctataatgtctttgtcttgtgacctcacacactacatacaaaatgtgatgtgttccttttctaaaacctccaaagtgccttccctttatacatacatgtactttgtctttatacatacatgacaaaataataatgataaaagctgctactgtctctcaatagtatcaggtacctcatatacattatgactcatgaatcatgatttcctctataaggaaaccaagttacaaagaaatgtaaaaacttattcaaattaaaatagctaaatatttctagaccagaaaccagttatgacttactgtatctctagtgctaaaatagtacttaggaaatagtaggtattcaatacatatttacaaataaacagaggattgatattgtcatttgaaaccctggtataaatgacatcctggtatgatacccagacttaacggctttaccacaccccatcttagatcttacctacattttttcattaatcaatagtcagatgaattagaaccctccttgaagccaacaatagcttcctattcatgacaacttgtattgtgttttatattcaacagagaatcaaatactaaaaaaaaaacaggagagacaattggggagagtgagaaataaagaggaaagaaagataaaggaaaggagggaaggaaggaagaaagaaaggaaagaaggaaggaaggcaggcatctgccaaaagtgataagattaatgaaaatggctccttgtataaacatattcctactaaagttacctggtctgtaagattatgtcaagaaaagaaattaatcattggcagaataataaagtttcaaataagagtttttgaagtatagtgatgtttgtcttttggctaggaatcagtaatggttgaaaaagctaccaaaatttttttcatgaacatttagtcttggggtagttatttaatttttaatatgctaaaatattgatctctgtaagttcaacattttaagagtctaattgttttctcctgtttaagagcaaataatttcatatatattgggtttcccattgtttgatgacgtagaaaacacagcataaagtagacattgaatgaaatttagttgaattttaaaatgaatagcaccactattactccatttgaaaacatttacatattattgaggtaaaaattacatacagtagattctcatcgttctcattagtcaatatatagttatgttctgtatagtcactgtgaaaattgaattggcaactattgaaccatttttcctacgggaaatacagggttaggttcctgccagcctctgatcacaatatttgcaccaactaatcaatacataaccttgttttgtgtgtgtttctgtttaaagttactgtatttaatatttatcattgattaaaactgaactcatgttcaacagcattataacttatgcctgaatcaaatttaacaaacacatattttttatgtaaggcacataacagctttaacttaggaacactaaagagcacttcagtactatgtcaggggaccgcttttaacagcaaagtcaacaaaagcaccaaagtataaaaaatatgacactggcagggtgcagtggctcactcctgtaatccagcactttgggaggccgaggcgggtggattgcctgagctcaggagttcaagaccagcctgggcaacccgctgaaaccctgtctctactaaaattacaaaaaaattagccgagcgtggtggcttgtgcctgtaatcccagctactcgggaggttgaggcaggagaattgcttgaacccgggaggtggaggttgcagtgggctgagattgcaccactgcactccagcctcagtgacagagtgagactccatctccaaaaaaaaaaaaaaaaaaaaaaggcactggatatacagtgaaaagaggcactggatatacagtgaaaagaatacctgtttgcaggttgagaccttaaacaagaaggcaaagcgttagctcagttggaaacttgtgccttaggaccactctgtacatgcatgagtctttaaatgaccatgggtattgattttgggtttataactaaattttagcaagtaggcaaattcacaaatgttgaatctgcaaataataaggaccaactgttcatgacatgcgcagatcttaaaagtacaattcaatggatttggatgagtatatacacttagacagcaaacatggaatcagcatatagaactttttctctccctcagaaagttcctcgtgccaccctacagtccattcccacttgtgcccaccttcccatagacagctgctgttctgatttctatcagcttgatttttttattctttttttaaattttattttacttgaagttctgggatacatgtgccgaacgtacaggtttgttatatagctatacatgtgccatggtggtttgccgcacctatcaacccatcatctaggttttaagccccacatgcatgaggtatttgtcctaatgctctccctcccctttcccctcactccacaacaggccccggtgtgtgatgttcccctccctgtatctattttataaactagttctatgaacatattcataaaatatgttatttttatgtccaggtttttcttacaaaacacaatattttaaaaattcattgatgctgttgcttgtatcactagttcattcctttttcttttttattatttagcaatatttccttgtttgaatatatactgtatgtacatgtgtttatttccaatttgcaactgtcatgaataaggctgtcaagcattcctgtatgagtatttttgcaacatacattctgatattggtagatatatacttaggagggggattgttgggtcataggattaatatatgtttaactttattaaaaattgtccagagttttccaaaaagattgtacaattttatactccaaccagcaatgcatgagggttcaaattgctctagatgctagttagcccttttaatttttggccaccgaaatgggtataaaattatatatcatggttttggtttccctgatgactaataatataaagcactttttaatgtgcttatgaataattaatagatctttatttgggatgtgacttctgcccattttttccagtgattattgatttacaggagctcttagtatattttagtatattctgttttaagatacatgcactgaaaataatttttcctagtctctttcttgccgtggattttattaaccatgtctgttgatgagaaaaagtttttaaatttgatggatctcaaattatcaagtgattttgatgtcctctaggaaacctctgttagcccccaggtcctgaaaatattctgttttcttaggtctcaaatcctttcagaactatttttttgtttgattgtataaagtagaagtcaaaaatacatcttctctgtatttatccagttgttctggcatcattttttgtaaaagacacttttcattcaccattaaattgtcttggtgcctttgttaaaaaacaattgactacctacatgtgagtctatttatgatctttctctgatgatatacatgtataatcttgaaatcaaatgataagttctctaacttggtttttcttttttgcttattttgaatatttaaggattttttttgcattttcttaaacatttttgaatcatctcatgcatttctacaaaaactatattgttgggtttcggttagaatcgcatggtatgtatctccatttgtttagtgccttaatttctctcactgatgatttggaggaatcagggtggaactttaaaagctcccccaaatgactctcatgtgcagacaagataaggaccactacctagatccttttttcttagaagaatttgggtgcctgtaagaaaagaattcatcccatccatccctaagattctacgtattaaataaatgaagtggtcatttctgtttgtttgtttatttgagacagggttttgctcttattgaccaggctggagtgcaataccacaatcttggttcactgcaacctctgcctccctagttcaggtgattctcctgcctcagcctctggagtagctgggattacaggcatgcaccaccatgctggctaattttgtatttttagtagagacggggtttcaccatgttggtcaggctggtctcaaactccagaccttgggtgatatgcccgcttctgccttccaaagtgctgggattgcaggcataagccaccacacccagctatgaagtgatcatttctaataacacatccaaaaaatgtcatgacatacgatctccccaatgtatttgttttacttaaagtttctattcaagtgatttttccaaaataaccacacattccaaagtgactctttgtaactttacaataaggcatttggcagtttctttatcataaaaaacaaaagtaccttgtacctgcccaagcacctttttacatgttttatctgacaacaattgatcatatttataatgtggtttagattggcatgtgaaaatgagaaaggtcaaaatggatccattttcttatgatatggaatttttatagataagaaatagtgcatggcatatttatatgaaaatttatatacctttttaaagttttattgcataaaaggataattgattattaataagatatattagtaacacatcatagaaccctgtaactgcctaaagatgaattcatattctaggaaattttgctctcaagattgaatattgatcacaagactgaaaactccagtcactgtaattttacttgaagcattttctaacagatgttacatcttggtttgccattatattttaaatacgttctttttcttttttcaacattcattaaaccagtcttttcttcttgtctctaataagagcaacatctgtttcttcttgttcaatcaaagcaacttcctcaagagtcttactttaaaaatgataacattagaaagcacggatagaaaacttttcattaatattttacatttgcatacaaaacaagtgtttctaacaattataagttagggaggtgttagagaaaatattataaaacaatttagttataaaaatataaaatgagaaggtgctgtaatatggtttcaaagatgttcgttttaggttaaattttctttatatgaatatcagtttccttttagaaggtacagttgaaacacttttatcattacgaattataacaatggtacataccacactgtatgtggtacagaattataacagtggtacataccacaccgggttccaattcaatctcagcctcttatggggcaagctccacgtgtgcctgaatatattatgaccccaaatataaggcaattctccattttccctggattattttatatttttactaacttgcacataaactgtcaaggcctaagtgaagatgtcaataatatttatgtgtttttcagattacatacataaatcatttagaaagttcattttttcattctcactttttagaaataattttgttctaatgtctgcacaggcaactttaatgtcagtgtctttgccctaactttgtgaatcatctacacatttctgtagaacaaatcatcttcacctttgtcttagttgtttaagatataggataagtttcccatatcactgtatatgttttcccaagcctcaaattcccattaacaaaggactggctaagatgcattttttagttgtcctgtaggtgaaatttatgatctccacattgtaaagacttactgcattgctttcttgtttagaaagcttatcactacattaatatttgtaattatgagatagtaaactccaaagacaatttttttttttgttttgagatgaagttttgctcttgttgcccattctggagtgcagtgacacgatctcagcttgctgcaacctccacatcccgggttcaagcaattctcctgcctcagcctcccaagtagctgggattacaagtgcccaccaccacacccggctaattttttgtatttttagtagagactgggtttcatcatgttggccaggctggtctcaaactcctgacctcaggtaatccacccgcctcggcctcccatagtgctgggattgcaggtgtgagccacagcaccctgatgaaagacaaattattaaatgtgtctcagcttacttttctatgaaataaaatgaattaaagtgtccatgtttttgtcttaataatatagatacactgtctcctatctggcagccaccattctaatgctgtacaaatactaatagtaactagtatacaaatacttaatccacctactcaaagcctcattttatttccagacctgatgctgtatgagatatggctatccccagaaactgagcacttctccagatgtggtagcaaatggaagtgtgtgtgcgcatgcgtgtgtacccatgtgtgtgtgtgcatgcgtgtgtgtgtgtgtgcacgtgttgtgtgtgtgtgtttgcatagtataagaaaactctgatcatggatgcacagggtctatataaataatgtattttgttgtggttcttgtttatttgttcaagctctagaaccaactatgtctgagttcaaattctaacctttacctgttaccatctataggatgcttacagattggtagactcagtccttccctatatactggagataattgtttaaaaaaattttgtgaggtattacgaatcaaatgcaagcaaagtatcaccatggctagcacatagagcttagaactttatactatatatgctgacatataaaaagatcatgaaattctattcttctctggagacagccttcaggatactatttcttacaagatgtagacaaaatatgaaagaagcagcacatttttctataagaaattgggtcttccttgccacatttaagaataaacttcattacatttggggacccatttttatcatagattactgaggtattacctcttgataattaacattaaaatttcaaaataataattggaaatgaaatgaataggaatcaaagcttaagctttgatacagtagtggctgctatcagcaaggatcctttaatctgggttctaatttctctagtaattaagttcctggaagaaaataaaataaccttttaattttaatctgattagaataatagaccttttgccatgaaaaattaaaaggaagatgttccatttctaaattaattttgtgatggagaaattgtcgtggaattctctgaaaggctttcttgttcttccacttagagtaaccgaagatattttataagggtctatctctggacatgtgattatttaggattggatttggggactgaacaaatatcacgttgatatctttgagatccatgtcctaaaactgtatttcatagcagggtttgtcaaattataaagacaaaaatcaaaaaaccatgcagtcctatagttaatcaacaataaatcctactttgtactttaaagggaaatgctatggtgaagatagggtcttcagtgcatcaattccttgggaatacccaaagggacccacttgagatggaactatttcagtaaacactgctgcttgactgacagttaacttcaagaataagcctttacatgcatagagtaattttatagtacaagagattgtatctgtgttgttcttcagaatatttgaaagataagaaataacatttattgttttcccaatttttgtatggacaggaaaaataaaactctgggattaaatgacttaagatattcttgtcagaaacagaacttggacttaaatcatgcctttttctttttccagtgaggaactatcttacaaagtaacctatgagtaccaaaaagtagaccctgatatatgaatatgggtgcatattgtttatttgacattggtccaataaatgcaatctgggagaggggaggtgagacaagttggggtggaaagccacaaaaaggttctttaataaggagattgttactatgggcacctgagttctagcccactggagtctctctgagaggctgtagtaactacagtcccttgcacacctagtttctggactgttcctctttctacatcattggaagccattgaaatgtatgggagttttctgcaggtgacagccagagtgggatgaagagatatacttcatttaataacttgataacagagaaaggtcaattacaaatggacttaggatgatggggatttccaggaacatctattgacattaaattaaacttaacaaaaaaaattatatccacttaatccttacccttagaatgagtcatattgcacattaccgtgtagagctgagaagccatagtcagcaactccaatgctatttttattgcttttttatgtttcatcatttacttggccatctatgaaacctagagtgccagattcctggtcatgatcactccctcagattcattcagttattcattcacacccactatgtaccagacatggttttaactttagggtttttttagtagagaagaaaacagacaaaagagagcttataatcaagtgatagaagacagaaaattagtaagtatgctagtaaatgaacatataataaatttagtaatgagaaactataaggaaaaataaagctcagaaaagaaggaatgttgggagagagaggaaaatgatatgttatttagaatagctaggaaagaccacctctctcttaagatgacatttgcacagagatctgatgtgagggagcaaaaccatgcagataattcacacgaggcattccagatggttcacatgacacatcttagttcaccaaaaggactttagtcagtacttttcgtgagttcaaaaagaacagaaagctgttatagggaatagtgtgatctcagttatacatttataaagataataccactttgtggggagattagactgttagtgcaaagagtgaaatcagaggaacaattggggggtaatgaaatactctgtattcatctgttgatggacactttggttgcttccaaatcttagctatcgtaaacagtgctgcaacaaacataggagtgcagatatctcttccgtgtacgtattttcttccttttgggtatatacgtagtagttggattgctggatcatatggtagaccagagatgatagtgggctcacatagctgtttgccttattacattatttatattatgcatactatttatacatatattcacttgtatgctaaattttataatttggaaagtcttttgcattaattcctttagagcagggattttatactgttttcttgattgaaacaaaatgtgctcagtggccaggcgcagtggctcaggcctgtaatcccagcactttgggaggccaaggtgggtggatcacttgaggtcaggagttcaggaccagcctgacatggtgaaaccatgtctctactaaaaatacaaaattagccagctgtggtgatgcacgcctataatccccgctacttgggaggctgaggtgggagaatcacttgaacccaggaggcggaggttgcagtgagccgagatcccgtcattgcactccagcctaggaaacaagagtgaaactccatcacaaaaaaaaaagaggggctcagtaagtattactaaattaaaatttgaaaatcctaaaaaaaacccacaaaaccctgaggggtgattatgtgtaataatacttactatgagtaactactacaaacatgtgactatcttctaagctccaacagcccttaagttctttaaaatagtttttctatttcttagtataaaccaactagtaatgtatgattttcctataaaggagcacatgtagtaaatagcctaggctttatgaactacatagtttccagtgcagctgactcttgatgtagggcatgtggtatgtaaataaatgtacttggctacattccaataacatttatatggacactaacatttgaattgtatataattttcacatgtcactaaacattattcttcttttgatttctttccaaccatttagaaaagtaaaaaccattcttagctcacaggttatagaaaagcaggtggcagcaagccagatttcagccacaaactgtggtttttcagattcctggtataaattatcaggagcttggagccttgatctgtgtgtcattgatttgctctcattctatttttggacacctttattcgttagagttctctttcttttgtgaaactgaagcacgtcctcatgtaacttctacctgtggattctacattgtgccgtctgaagaagaatagcacaaaataccccccacccaccaccttgtcatagcacaggccttcacagggtcgaagaaagcccctctggccctcttggttttctctgctacccagtgttaaactttgtccagatgcttatgtttcctggctgctctcctatttttgctttttaattttctgactattcttcataaaatgaacacaaactaaacaaaagctttaagctactgtccagctaatggacaattcaatctaatttttgtttccaaagatcgttgtatcaagcaacaatgaagtgccattgttggggatatgcattcttgatttattttgctgttttttttttttaataccatgtactccattataaagataacttatttgtaaatgttcagataatcctatcattattttccatgactattagtggtcagttcgtacttataactacacatgcacagttattatttagtacttaatttctataaactatacttaccaaatgtgtttattgagagaaaacaagctatacagaaaaataaagattttaaaaacaaagacagactttagataaaagccataaattcattttcttgtctgagaataagatctagcaaagctaaccagaaaataaattactaagttaaagtagttcataattcactaagttaaaatagcacataatcataaaatgtgctcagtggctggatgcagtggctcacgcctgtaatcccagcactttgggaggccgaggtcatctaaatgactttttttcaatccatttctttccctaagtacacagcggtattaatactgcttctctacttgattgggttatattatgccttattcagttaggtggagtatagaaccacttatgatgatgttaaagagacatgagacgtcagtttgaattgtaagcagcactgtattttccaagagaaaaatacttttatttgtaaaatcgtgatttgttgattttggaaattgtgttcagctgggtaattttaagataaaaatgacttttatcttgtacttaccaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggtaagaatgccattcctttttggttactaatccattgcaaaaaatgaggtttcaaaatgaagtttgattatgaagtatttatatttgactcaactgactcagtagatctcatgacaaaacaaactgtaattccactgagcaaaacaaaaaaagaaaaggaaaaattttatttctttctgatgaagatattaagatgatgtcaccatattcttctggcctaatttaaatcattgaagtataaaaaaggagattctaaattcatcctcataatcctcaaaagtcaggtccttggaatatttgctgttcacctagtgctttgtaactaattattcaaaccttagtgtcttcaaacaaacatttattatctcgcagtttctctggatcaggaattcagtagtaatttgctgagcgagtctttcatgaggttgacgtcaaactgttacttgtggctgcatcattggaagcctcgtctgcttccggtaggtctcacttacctggctgacagttggtgctggctgggatgcctcagttctctgtggcctctgattctgtaatacctttcttcttcaagtagcctctcccgggggtcactgggcagagaaatagagagggaaaaggaaagaaagagaggaggggaggggaaagccagtaagtcaggaagttctccagataaaaactatgagtattttttaaaatataatccaatttagcagtgatatcccatcactactattattttcaacctgtgggaagtgagtcactaaatcccgtccacagttaaaggaaggggatttcacaagggcatgattataaagagccattgattcctgggtgccattttaaaggtgcctaccacagtctaccttacagaagaagacatgttgtcacaaacatcttggttcttaagtaacgaaaagattagtaagaagaagattatcttaatgataaactctatgtgtgaaaaagtgttgtagcaaagacctgtcacattttctaattgaaaaaatgtgtcctgtcagaaaatgatctttttcataactaatacattatgaggacatattttattaaagtgctgggtactttgtttagatcaatacatcttttattagattattgtgtttcctgtcctaaatcacgcaatgtgagatgtaaaaaataaatcacatgcttagaaaaggcttttatttaagctttaaaatctgtatgttacatgtttgcctctgaaaatgtttctatttgtatttacatatctactttgtttaattaaatatatagttatatagctctctctctctctctctctgtgtgtgtgtgtgtgtgtgtgtgtgtgtgtgtgtgtgtgtgtgtgtgtgtgttctagtttttagagtaaggtgacatgagagcagccaccttgtttatctcataccctgctatattcctcaaggtcctagaaaaaatcctggaatgttgtagatgaacaataaatatttatgaaagacttagtaaattctacaaattaagcaagacgtcactttattatgaattgtctagagaggaaacagaggaggccctaggcaatttactgacttgccactgagtttgcagctagcaccttaagttttctgagtcctataccagggcatttctccccatctaattagtgacaagttagagacaaaaatcatgaactagggctctgcttctttaatcttccataatatttgttggaagttaagactacatgatttttaaaagactctcaataaatatttgatgagtagacgaaagtcaaacaagctgtcttatgagtgaatgaactggacatactgatgtgagaaaaaacaactcaatagccaaactggttaccgtccaaaaaaatattcaatatgattggcttatggccaacagttttcattgctatgatcacaaatagatcacagttgtcagtgggaaagctactgataatctctgctgatcccttgactggaatatttttggccatacatgagctccctgaatgcctaaggccagtttttatcgatttcaatctagaggggcgagcacatagctgtaaccacacattcatggcatagagtttataggatatgaggtctttatggtgtgctatttacatcagtttacagattctggtttttgagcccaggagtcaggagaatattgatttcctcttgggtctatggtctgcctttaggatatactgtcagctaatgatcacgatgcttgttttgttatatcgtcattagctgaatcctaagtgtgtaagaatcatgagaagaactcattgccattctggctctcaggccccacctctggaactttgaaattcaagagaatgagaaattgaatacttaaaaacttcaagtgattctgataaacacagtctgagaaacagaattatagattgaccttagccaatttgcacacatgccttttagattctttttgtaaaacatcgtcagtcactgaaaagtttgggatgcatgagaattagctactctcctatagctttgcccccagagggcaaaagaagggaagtcacaggacaagttatgatgcccataaacatatttattaaatgaacaattattaccaagaaagcacagcactgttcataaacattcttctgcaagctcagtgaggtcccagctctctaacttgctgcaccttgaatcaaatgttctcccgaagcagcgacgctgaatggtgggattcagctacacccagagctggtgccaggtgacagaaagcctcctcagcgaatgactggcacaggatcactaagtgatgctaactccagaagcatttctaagaactcaggttacaggcctcgccagaatcttttaccatcttcacacaaggctgggtgtgtctctaaaaggtgttgtggcaaaccacagacccttaatgcctttaagttcactactgatatctcctttctaacatttctttaacatttatgctatctaacagaccactgatttcaccaaagaaaacccagtttggcattcagttcattagaggacttgttgattcagtgaattaagttgatatgggaataaatagtaaaaatctaagagtcaccccctctggtgtgggtgtaccgtttctgcactaaaactcttgacacctcttacttgtggattcctgatcagaagaggaactgcctctggatcgcaactttaactaaaacacaaatgcacacaactctataccatctgtgctgaaaattttaaagtaggattcaaatgttaaaataaacacatcttaagaaatactagtatagtggaaaggagaattgactttgttctaaaacacgagctttggaatcctgcatacctgattttgaatatggctttatcacttaattagtggatcctttaatactgtatcttactttcttcatctattaaatggcaatagaatctgttttctgaacactgtgtggcataaacttaaacctgggatctgaccctaggaaatgctaaatgctgactgactttccaatgcatcttgagcctttcttttaactctgtaagagacagcctcacaaggaacactggagacttcagaccattatttatttaatggcctctcatcaacttctgcaccactcaaagtatttcttccccacactcactgaagaaaagtatttttcctgctcactgaaagcctcaagtaaaggctttcctgccgtcctacactctgttttgtttccaaacccttaaatacgtccacattttgtttcttttgaagttaagtcccggttgtgtagctttctttgcagcccaggctgggccgtttcactccagtgtgcaattttatctctctgtgcttgctccctgctaatgccggcaaagtcttagtcctcctttgtaacatccatgatcagatgatgtttaatcaccaagaattcttttaattttttttttcttggggataagcagacaaagagatccgttatttggcatgtttcttcagtaaagtgtgttttagctgctttaacatgttttattttcctccaactagaatttttttagataacactccattaatgttaataatcaaaagaatgttaaacacaataattaaatttacctattgactgtttacgtggtaataagctttctgatacaggccggaatccatggctatgagacagcagtatgatttttaaatttctaaattttctttgttgtggtcatttttatttcctcttttgttatcattaaaagaaaaaggagctgtgggctgaagaggagagataagaagcttctagagccagtcttactggaagaggagttctaaagaactcaatggggaagcaggcaggtcttaggaaggtaccaaagcaagtggtgaaggcaagagaaaaagaaagcagtggagctggcctgagtttgataggataggatttgtgttaatgaagtttaataagagggcacatctctttccagctcaccagtacataactgtgttggtcagttttggctgctataagagaatactataggttgagtggtctaaacaacataaatatgtttttcatggttcttgaggttgggaagtctaagaccaaggtatcaaaatgcgggcagattccacgtctgctgagggcacataatgagaagctgcagacaaccattttgttattgtatgttctcatcgaagaaaaatagagacagagagagaaagacagagagcacacactcttaagtctcttcttatgagtgcaccagtcccatcataggggctccaccctcatgacctaattagcccccaaaggccccactcctaataccacccacaggggctcggggtttcaatatgtgaattttgagggacacaaacatatagtctataataatggcctctcaatcctcattgaaatagaccatggattttaaatattaggttgtgcaaaaccagttggggtttttgctattgaaagtaaaggcaaaaacgagctaaccagataggtatgtaaatatagatttttatcaagtagttatgttttaaaataattaggggatgtggttatcaggctccttagctatttattataggaaaataccaacactccttcaagcatttggctgcctgaaaatttcttagtgatggaatacactccatgaaaagcctcccagatagtttcccagaaatccttggtttggctcatccatcaaagaatacgaacttgcagcatcccattcagaatccacttgtcagcactgtgaagtatcagctgccttgcttttgtaccaacaggaaatctattgtttagaagtttgttttctagctctttttcattgttctcccaaaaagaaaaataatggaatgagacacattttatcaaatgatataagttagacaatgtgtcatttcaggagtgtgcaaattgaatcctaaacaaactttttgaaggtacgtattgattttctagggatgccgtatcaaagtaccacaaacacggtggcttaaaacaacatagttctattctgtcaatgttctggaggctggaagtctaaaatggaggttcaacaggatcctgaggtgtctgaaggccccaggggaggatccttcaactcctctggcttctggtggttaccagtaatcctcgttattctctggcttatagatacctccctccagtctctgcctccatcttcacatagtctcctcccctttgtgtttccgcatctgaatttccttcctctgataaggacaccactcatgggattaggtatcatcctaatcattatcacctcatcttaacctgattgtatctgtaagaaccctatttcccaataaggccacattcataggtttcacagttaggacttcagtgtatctttttggaggatacaatttagcacatagtaaggtataaatgctttattttacaaccccctctaatgaaaaattagcagacttcctaaaggagattcatacttctaattttatattatctattctcaaagatggctcttatgaagttaaaagtcaaacacatactttgagaaatgtggataactaaaagttagaggcattcaaacaaacaaaaacaaaaagtatcgtgcatagtggataaaaatgtgctggtcataagaatttgatggtcaaatttctgaatgtgattttgtaacctctgcgtaggaccacgtatagaattgcaaggaaaccaattttaaaattctccaagggaatttcatgtccatatgcataagagagagaacttatctctgataaatattggaaagctttgtgtaaaaaaacaaagtgtaaatgataagaaaatgtatcattggtttgaaagcacattctacgtggaactaaccgaatgttgtatcgttacatttgggtccttacacatgtaatgtagagagaagagaacacccagctaagacttggggttagcaaccctcggagcaggattatacttagggacaaggggaaagaatctggcttcattgctttggttgacccgaaaaattttcaggaacaaaggaatttgtaacttgaccttgatatgcagcaccatgggaacctcccactaccaaataaatgaaatcattaaagactttacttgtagatagtaataatactggaaataaaacaaccacacacacacaaagagtgcaattaaaagaagaaaaaaatcttaaatttgctttcatttttccttagaatgtagttccctttccaaaattacatgtatttaagaataaattaagtcatctttttgtcatactgtacttgtcttggaattttgtacgatgggcatctactaaacagtgaagcataagcttaaaaccatagaaatattacaaagtgttcccagagagttgtttacgctaaaacaacatgaaaagttgaagagaacaccactggcaccccatcgatatacattaaatcccttagcagcagtaagaaatgtcctcacatttaacatataaatgctgggcaagtcagctgtcttatatctaaaatcttctcataagaaatgccttcaggccaggcatggtggctcaagcctgtaatcccagcactttgggaggccgaggcgggcagatcacctgaggtcaggccccagcctggccaatatgatgaaaccctatctctactaaaaaaaaccacaaaaattagccaggcatggtggcacacgtgcctgtagtcccagctacttgggaggctgaggcatgagaattgcttgaacccaggaggcagaggttgcagtgagacaggatcacaccactgcactccagcctgggtgacagagcaaaactccataccccacctgcccccccaaaaaaggaaatgccatcaattaaatatggttatttccttcaaaatataagtccttaaactcaaactgtaattagattaatgtttgatttttctctacactggctgaaatagtaaatctttttatcttttttctaggcctgcttttgcaaatgtttttgaattcgctttgatgttttcattcatactgtctgttatagaactaaggcctacattcattcatttatatccaaagagattatgggcaactaacaagtagtagagcttggattaataaatattttctgaaaacctggcattattgttcatgttgaggtagtgaacaaatcaggggaaaaagtgcttgctcttggaagattacattctaggccagatagtaaaccaataacattggttaaatgagtgtatttgggggaaaattaatcagggaggggacaggaagttcttgggaggggattgaggattatctttaaatggccagagaaacctttgattaagaagatagcatttgagcaaacccctcaaaggagtgagaacacacacaccatgagaagatgggagagaagaacactcttggtagaggggaaagcaagtggaacccgatatccagctggtgtgtgcagggagcgattaggaaagggagtcagtgtggctgagaaaaggtgaggttggattgtgaagggtctttaacaatgactgagaaggttggaccgagtgaatctagtttattttaaaacagtctctcaggctgctgttttggtaaaaggctgtagttggatgagggagaacagtggcaactattgcagtaatccagatgaaagaaaatcgactagattgtagcagtggagccagtaggtaatgatcaattctgcatacacatttggaggtccagccagcaggacttgcagacaggtgagatatggggtgtgaaagccaaagggtcaaggatgacaccggtcttcctgacgaaaaggctcatacctcccctttccactgttttacactttctccttcccctttcacaatttgaggtccacttcactgtgtttccctgaaaatgacttttgacctatacatcctaaaactaaggaatttgttctgtatgtggtcatagttccaccaaaattaacggaaccatggacagctccctcccaaacaaaattcccagcgtcctgtctcttctagtttcttttgatgggttctcagtcagttccgaaattcctcagatcaagtcttggctgaatgctctttctgctgcatctagggtcaagaatctactcatctaaaacctgctatggtaaattaaaattccaatcagtctctaatttggggaccttgccatttagaaataagcaaatggagaaccctgacttaaagctaagaagctgttatactaaaaatagcctttaaaaatattgattcacaaataacctcctcaagcatatacttccaccttgaaaataccacctaactgtaatcttttccttttggcctttgttccatcagtgttccaacaatactactggggttggaggggggtagaaagtaaactatttatcgcctcttaaaatctaaactggaaattagctctcatccacatttacatagtgctgaatatccttcattaatgctaaagtacttggttaccctatctcacttttgtgtaatatgcctctctttgaaatgctaatttagtattaaaagcaaaagccaactttttctaaccaaatgactaacaatttattaaattttagagtgagatgaggaaatcacaacttagaaccttagcaatttctgtaagttgttaatggttaatttaatttggcttggctaatattatataattggaaattatttttatttactgcttccaaaccttttagttaacattttgttttatatttttcttagtatttttaatattttccctctggtccattattattatgtgattattttttccacttttttcgtagaggagtttgtcctcccctaattgtagtgagtcacctagaaactctgtgtcaattaacattttaagcagtacctgattatgcaaaaacaactccttgtccttgaaaatattcaaatcaatatttgctattttatgcaatgttcctcattttaaaaaacactttttttaacttttatttttggttcaggggtacatgtatagggttttctatataggtaaattatgtctcatgggggtttgatgtacagattatttcatcacccaggtgtaataagcatagtaccatataagtagtagcttttaatacaaaaaaatttttaagccatcactttctattatgagaatatcaatgagaaaaaaattttcaatctaattcccaaagaactttcaggctttttttatttgtttaccaattatatgcataaaagaaaagagcacaaaaaaaggaattacacattgaaattgaacatattaacctcatcagaaactgtttttccacttggagattggaaagtatttattatgtagcccaagattcccaagacttttttttatagctcccacaagtaaaatttgattagagctatgttttaaactaattatcattacaattattgtgatattctacatgcctttgcctttttctggctcttacaactggcttgcattggaaatactcagatttaaggaatgattacaagaagttttcaaagaaaaatatcataaaatttcaaaaactctttgactttcaagaattggcttaaccctgcggccatttaccattgacatgttctgctttcttttttcttgatactgattttgctcttttaaaatgattagcctaaaagaacatcaagatctgactgtgaaaataatacggataacactaaagataagtaaattaaatattattttgtatgtgaattttttagcaaatatcttctatatctaaaatgctcttaagtagagaaactactggccaaatttttaaaactgtaatgccttgtatatctggtgcaaatatgtgataggtgtcaagtgattacttgggaagcataaataagtctacagtttatcctatgaagttgattttattgtgctttaacaaaaagaaaaagaaatctttaatgtatccttcatgtttcatgaataatcagtgttaaaaaaaattcaaagagacatgttaaaagcatagtaaggaaggctttattcagaaccattgcaatagatacagggaccactgcaatataattttgcagcgaggaagagagattgggctcaactccaagtataggaaggacaagcgggaatttatagcaaaaagcagggttgggtcagtggatagaaaattactacaaagaaacaatccaggagtataggggtttctaaccaaagccacctaaccagaattcttgccaaaaacaggctagagtgatcagacatcatctgtggggtggtgcaggaggaacgtggtcaggtatcaaggatgatgagatactgagaacgatcagctctcaagggcggggagttctggctaaactgacttcgcagggttcttttgctaaaactggattttacaagagagtaaacagatgggcctaggagaaagttcagagcctgattaaaatttggtaaagaaaagaatcttcatcatgggttagttcaggtactctaagaagcagaggttaagacagaatcagacaatcaaaagatttattgggcaagtacttctaaaggaaaaagaggttaaagaggagctctgacattcaagaatggtgaaagggaaggatgagtgagtgggtagggccccagatggttgcacagctgaggcagtattggccagtctctagcaaaaattgtctgttagaatcctgtgtcagaaagaaatggcctggctctcttactcctgctgtgttcagactgagggcagtccaggcagcgtggcctcagctggtaagcatctgtggaccctatttagagcagccaactctgacctcaggtaggaagggaaatgtcaccagggcccttccttagtagccacaagtcatttggtaatgacacaaaaatgcaatacataaaggtagttacaggaagttattttaaagcacttcttgacaaaccagaaagaagtttgtgtttttttttccccaacaaagttgatatttttgtttgcatatctaatactctatgacagaacaagtaggtagaggagatgaatttagcatacttacttttttgaactgctggaaattcaagtaatattcttatatgtacagaaacaaacagaatgggatcccgtgcctataactgtgatggtctgttattgcttattttgtctgcttgcctgttttgtttctcctttaggcaatcaattatttgtatgtaaatttaattattaaatttattattatttacatgtctctcttttaactaaaaagttaagttctttctggttctgtggcttgttttccattgttgagtttttaaaaagatcagattttaaaataagttagtttttctagtttggtttactcacgtagtaattaaatagagcttttgctgaactcacccctccttttatttttaatttctctttctactttgggttccctttgtccatcccagcaaccagatgtttctcaagtaatgaaaaatattttctactcctcctgggaattttattttattttattttttattattattatacttcaagttttagggtacatgtgcacaatgtgcacgttagttacatatgtatacatgtgccatgctggtgtgctgcacccattaactcgtcatttagcattaggtatatctcctaatgctaaccgtcccccctcccccgaccccacaacagtccccagagtgtgatattccccttcctgtgtccatgtgttctcattgttcaattcccacctatgagtgagaacgtgtggtgttcagttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtatttgtgtctttataacagcatgatttatagtcctttgggtatctacccagtaataggatggctgggtcaaattgtatttctagttctagatccctgaggaatcgccacactgacttccacaatggttgaactagtttacagtcccaccaacagtgtaaaagtgtttctatttctccacatcctctccagcacctgttgtttcctgagtttttaatgatcgccattctaactggtgtgagatggtatctcattgtggttttgatttgcatttctctgatagccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggattttagccctttgtcagatgagcaggttgcaaaacttttctcccactttgtaggttcccatcccactctgctggtagtttcttttgctgtgcagaagctctttagtttaattagatcccatttatcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccattaccatgctgttttggttactgtagccttgtagtatagcttgaagtcaggtagcgtgatgcctccagctttgttcttttggcttaggactgacttggcgatgcgggctcttttttggttccatatgaactttaaagtagttttttcccattctgtgaagaaagtcattggtagcttgatggggatggcattgaatctataaattaccttgggcagtatggccattttcacgatattgattcttcctacccatgagtatggaatgttcttccatttgtttgtatcctcttttatttcattgagcaggggtttgtagttctccttgaagaggtccttcacgtcccttgtaagttggattcctaagtattttattctgtttgaagcaattgtgaatgggagttcactcatgatttgactctctgtttgtctgttattggtgtataagaatgcatgtgatttttgtacattgattttgtatcctgaaactttgctgagataagaaattttgtaagactttttggctttcaagaccctaaaaatggttgaatatctaatgggaaaatttgaagtgtttttggggaaatttgaagtgtttttaggtataatgtgtgggattgagggtccgggaatttaggccaaagactttcctagtaacatataattcagcctacttcaaaagttagccttaaacttacattgtctttaatacttttccaatcaaaaaaatccccaagcctctctgacatctagatctttctatctcattcactgaagttaaatacaattagtgccaaagttactatggcatcattcctctgtagaacttaatctataataaccagtaagttcactacctcacaattgggaagagagaccttctctgtttttagacacccttattagatcagtatgcaaatataaaatttgagtaaagatattctctgccagcattggactatatggtattatttccaggagaagctacatgcttcaaaaagtcagcaataaaaaaaaaaatcctttaatatctttggaacttttcctattatctatgggctattgaacaaagagatggactcaaggattccatatgtatacatgattttaggtttaatatttaaaataaaagaatatttgaagggcagaaaatacatgtaaagggggaattgcccctagtaaatatatagtcaatgttatatgtagaaaaaaatgttggaagatcaaaagaaggaaaaaattcaattgggctttagggtggaaatgcaagctatcaggctgaatgaagcagacgggtaataaccactatgtaaaagcttagaagaaatagaaatagttctactatttgctagcctagtgcaaaagttgattcgaagagcagtgggcagagattttgtgtgtttgctaagataatacatgtttcataccaggctttcacactttaatgtccttaagaaccttctagggtactttacaaaaaaaaaaaaaaaaaagtctttggctgccttcttagtaaaattctgattcagtaggtatgaggttgggcccagaaatatgcattttaaacagattttctttttttcttatcattttattggccaagaaatcatatgctataaaattcaccatttaaagtgaataacttggtgtgatactccgaatattcacagagtcttgtaactatcaccacaatctaattttcggccattttcatgaccccaaatagaaccccaaaactattagaaatcactctgaattcttccacaaaaccccaaatcgtaggcaaccacggcaaccacgaatctactacttcctgtctctatggatttgtttattctggactttttttttttttttttttttgagacagagtcttgctctgtcccccaggctggagtgcagtggcatgatctcggctcactgcaagctccgcctcccgggttcacgccattctcctgcctcagcctcctgagtagctgggactacaggagcccgccacacgcccggctaattttttgtatttttagtagagatggcgtttaactgtgtcagccatgatggtctcgatctcctgacctctgatccacccgcctcagcctcccaaagtgctgggattacaggcgtgagccaccacacctggccttattctggacattttatataaattgaattgcttaaaaaattatcttttatgactggcttctttcatttagcatgttttcaacctttattcaactgtagtttattcaattcatgtaacagtactttatccctatttattgccaaatatttttacatatatgtatatacatatatgtgtgtatatatatgtgtgtatacatatatatgagacacttattcattcacaagtgatggagttttgggtctttccaccttttggctattatatataatgctgatatgaacattaatttacctatttttgattgcacatatgtttttctttctcttgggtatatacctaggagtggaattgctgtgtcatatgataagtctatgtttattgttttgaaaaattactaaattacttcctgggtgatctcaatgcttgtcattctctctccatactttgagaaacactaatgtaggcaaagatttggggataaaaatgtaggaaaaaaacaaatgtctgttattatcagacatttgttgcactctgataataaaaaccttagatttcatgaaatggagaggaggattagaagagaggcaaagaaagcatcagaaaaataagacactggataatgatgtgaggttagcatcatcaagggacaagttagaaatccacattttaaaaaattaaaacaaaattatagctaagtgattaagtagtataagaaagtttataatgtgtgtttattaaaaggagtgttaagattttatttatgtggagatgatacaataaggttagccctcaatcacttattaaaatcaatttattaagatttaaatacatatagtaaaatttagttacacgaattttgattcatatacttttgaaagaatataaataatggtaacggatcccattgtatgattacagaataaagtagttatatacaagaatgtttattgcaacaacatagtcatcaataactagaaaatgcctaaatgagcaacagcagaaagatgctaaaagatactgtggcaagtctataaaatggagtattatgcagccacccaaagtcgtgattttgaataatattaaatggtatacaaaaaggttaatgacatagtcttattgcaatggggataaaatattttaatacaatacaaatttataattgcattctcctagacctgtctaatattttccatatcagtgaatgtgccattgccctccatccaggataaagaatgactttagtcttagttttatcttaatgcaacaaatccagtccttcacccaatcctatttaagtatttatttattatccataactattcatctcataaatgattttataatccatctgcctctcagctgtttcactgccactgtgataaaccagactaccatattctctctgcaggactgcttaacagttccctgatttatccactgacggtttcagtccattctagttagtcctctttcaatctatcttccactgactttgtcttgccaatttcccctaccctttccaccctcactgacttcctgtttctcttgtgattgcaatacttatttatttgtttagcaatgcaaatttataacctgaattacaaggaccttgcatcgtatggttcctttctgtgttacacacatcattcatcctcacccagccttctgcttctgtgcaccagcatcatgttggccttccttgagctaatagagtgttatgctgcctttgtcacagggatcctacacattctactatttcctctgtctggaatgttcttcagcctaagatgactacttctttctcaaatctcactttaatcaacacttcttcagggaagccttccctttgtctcagcccctggctaaggtcaggttctttagttttgagtatatataatagattataaagatatatgaattagggagattatttgtttaatgtctgcctacctcactgtcgcttaaacttcaaaaaaaggatatatatatatatatgtgtgtgtgtgtgtgtgtgtgtatatgtatatatatgtgtgtgtgtgtgtgcgtgtatatatgtatctcttttttttccttggcttctcttttcctggttttcccttctcttaactttctgctttctacggtttgtctctttcttcttacctagttttgtacccacccattcctcactgtaaaagaaagtaaaacagaattttagcaatactatctctgattcgaagaatgaataattttaatgttctcctttcttttttcgttaaaattttctacagtagccatttgtaggtataaaaccaacatgacaagcacttttatagtactaaaaaataataagtgaaaactacttgaatatatttccatataaaaatgtaaagttcgctgggcgttgtggctcacacctataatcccagcactttgagaagctgaggtaggagaatcacttgagcccaggagttcatgaccagcctgagcaatgtggtgaaaccccatctttgcaaaaaatacaaaaattagctgggcatgggtacgcgcacctgaagtcccagctacttgggaggctgaggcaggagggtctcttgagccttggagtgcagtgatccaagatcgtgccactgcactccagcctggagaacagagcaaccctcttttgtttgtttgtttgtttttttaaagacaaaaattataagacaaaaatttaaagacactgttatactatgcagccataagaaagaatgagctcatgtcctttgcagggacacagatgaagctggaaaacacaggaacagaaaaccaacaccacatgttctcactcataagtgggagttgaacaataagaacacatggacacagggaggggaacatcacacactggggcctatcgggaggtggggggcaaggggagggagagcaataggacaaatacctaaagcatgtggggcttaaaacctagatggcgggttgattggtgcagcaaaccaccatggcacatgtacagctatgtaataaacctgcacgttctgcacatgtatcccagaacttaaagtaaaattaaaaatatatacgtatatatttaaattttcaaaacaggagaaaaatgtttactttagaaaagcatgtctttaattttttctaattttacatagacaagagtttcatgtggtaggaaacaaactagataagataaagggaggtgaaatttgtcaggattatttttaaaaatataagtggataaaagtaatcttctgacatagcacttgtgtttaaatgtacatttgttacttacagttactaataatttattcatgtaacaaaaattgttgaggtttcttcttttttgtcattggtgagtggattttactttccagtatagaatgtccataaacgcaatgtgtccagtaagtttaattttaaaaggctttatattgcatcaataatttcagaattctttaccatacttcttaattctttaaaaacattaagtatatatacatttttattagggaagttaatctcttgtgttatgtcaaagtatataatggtaaatatcaactaaatacattgtttcttttatttttcctttgcacttatatataagtaatgttattttgttttaagacaacagtctcactctgttgcccaggctggagtgcagtggcatgatctcagctcactgcaacctctgcctcccaggttcaagtgatcctcccacctcagcctccctagtagctgggactataggcgtgcaccaccatgcccagttaatttttgtaattttagtagagatgaggtttcaccatgtcggccaggcttgtttagaactcctgagcttaggtaatttgcccacctcggcctcccaaattgctgggattacaggcatgagccgtgacacccagaaatgagtaatgttaaatataggatttctatattgaaaatattatagatataataatattaacttttaagatagagggaaaaaatccaaattattaggatagtcttcagctatataattatagaaatccaacttagtaacgatttaaactggatgaaggggctggtatggcattttgtggtttcacgaagtatgaattctatttcaagcatcagcaaactcttttatatagggtcatatagtaaatattttaagctttttgggccatgtgttctttctcacaactactcaactttgctttgtagcagagaaacagccataggcaatacaaaaataaatgggtatgtttgtattccagtaaaacatttacaaaaacaagtggtggattgcatctagcatgcaacctctaatttaacaagttctaatctatctagattttccaccatctttagtacattgtttctcactcttggtcaagatgtcttccatccccattccatacagcaggaagaaagaagtgaaaagagtcatggagcccctttctttaaggacacttcctgaaagatgctgaagatatttctacacatatcctgtcagccagagcttagtcctgtggctacaactagttgcaaagcaagctgggaaataaaattcttccagacattcatgaatccagtgccccctcccctcaaataaaaggtgcagggagattttttactgaaaagatcatgaaaacagattgtagggaaaactgacagtatgtaccaatattagtacacagaaatacctatattaaccctttttccaatacataggacatttttatgttccttcaagtgagaccttcccaaaatctcataagttattgcatccatctcaaatccatctctgatgatgtacagaactctacgtcaggtcaaggtttcatttcttgtggtagagtagtatataaattaaaaacctgtttactgtgaaatacactcctcttatgaaaataaaagcatgagagacacatagccattgctggtccatagcaattttaaaatcttgctaggcaggaatagcaaagaggctatttttccagtgccttttgtgacccaaagtttcactctcgcagaggtccctatgagaagccatatcgtgatcctatctgagaagggcattctgctttttcctgtctagtgggctgcatgctttcataactgacctcctgctgatacaaattagtgattaaggactgctgaagtcattgaaagggcacaaaactttgcaggccatgcttatggtttccttggcaatgtaagtttctcaaaaatgttatagtcttctaatctattttctttcaggcagttctatgtgcaaataaccacacctaaacatctgttcttgacatagtttaaaacctgttgactattctttttcatacttacctctgtgttctgccaattcccagtggaggtgagccctctaatctgccttcaagagaacttgcacctccctccttttcttctctctgcctttcagctaatgtcaaactaccttgaggtcctgaaaaagaataaacctttagtggacgatgatatcctcaatctgatcactgcaacagtgctgtgccccagtgtctggtagataacccttacctgaaggttatgaaagacatcctggggccacaggcttacttccttctaaagctgcctcttggcagctgtggtttagacttacaccataatgcagtttaggatacagagttattttttatttttttcatttttatttttttaaccctttcaagcttctgaattagggattttccatcattttagactgtcaacataagaagaaagcaccttctacttcacagtagctttactctcatctcagcctttaggctggtgagttctagactaacttcatctctctcctggagactttgctaaacacagcaagaaggagccagtgccagtgcgcaagagcacttgagtctttccaagcatttctcttaacatggaaagtctcagttggcacctaatttgccttccaaagacagcagttgacaatataaccaaatatttagctacggtataacaaagatctcagctttccacagctagagtatcccagtcttcaaggcctggtgtccaccacaggcaattccatatgctttttaggctttgtcacacatagcaccctatttttatgtatagtacaaactatggtatgagtttggattaggttcagcttgagtaacagagactgaaattaacaagatgaagatttcttcctttgttatatgagagaatatagaattagactgttcaaggctaatgcagtgttccatggagtcaggaagctaggctttttccatatttctgctttatatttagtacaagcaaatatcccaaatggcaatttgagtgccagatattacatccaagttctagataggaggaaaaaagcatcaaaagatatggggtgattctcacccttcaaggccactcccctgaaatctcatacaatgtttacgcatgtatcacctcattggctggaacatattaatgtggccacatatagttgcaagggatattggataaccaaatatccaggtaaagatctaagtctatgcaaggggggaaagtaattattgaaggctaattagcatctttgtaatactcctatatttgatattaaacagtttatattatctgtgaatttgattatagtttgtgtgctcaattgtatttaataaagtggcattcaatatttattccctccgtgagcaaatcttgaaaatttgtatacggctgtttaacctaaggatatttttgcatcagtgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggattagtcttgggagggtgtatgtgtccaggaatgtatccatttcttctagattttctagtttatttgcgtagaggtgtttgtagtattctctgacggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctgtatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccgactatgtggtcaattttggaataggtgtggtgtggtgctgaaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgtgagtttggaaaattcatttaaaggagttcatttctttttcaagttttcaattatccatcatcctagcctgaagctttttataacaaattatttagagtagtaaaattagttttttaagcaatagaatattttttaattacgcatttatatctctgttattcccaatcatatttctgttctccacaaacagctttattcaataaatttcttgcctttaatttgagagaaaaatggaccatttcccaaaacattaggatctattaaaaataatgtggatggttatctaagagcttttttttctttagcttagaaagcaaaggattatacatttcttagtttccgtatggcagaactattaggaaaaaaaaaagaaataagatcatgaaggtatagtgtgtagaataggaaattaagaggccagagaaagtatctttggaattaggaagctgtctaagacattgatggcttgaaaagaagtaaggtgtattaggtgaacaactagatcacaaggttcaggagagcaggagctactcttgattttgtttatcccagtacactaaaatataacacagtgtctgatgcatgcaaagcactcattatacatcttttcaatgaattcataaggataattaaccatattttaaaaactattagaaatgtttatattattgtgtcctagaagacaacagtgtgcatgatttaagcatttttattttttgcaatcacgttattaaagaactctaagttgcatcatgccacatcagatatgtaatccattcagccttatgttttcatctctggctgtagcattaaagcttaatttatagaaaggtgtgttctttccctagatatcaacttaaaggttaaagacatactttagaacactttagtctttcctcaataaacatctccagtttttcctcataacaatttcatcaaatctttcttcaacttatttgtatattttaaatttatatggtcccttaaaaaatcacatgctgattttatttttactttttttttctagtttatcatttgtttttcaaagaaaaatatcttttaaactacttgtttaatgttaaacaatgagctgggggggcattttgtttttgtttttgttttaagtactctattaattttcattgccagtgaagacctaactggctaaacaaagatacacctcagcagtattcttgtttgaaacaacatatgtaccaactaggaaaaatgcattgttaaaattcactgcatgcctgtaggtaatggcagaagtgtggaaaggcagcctctgactttttaaaacatccatgtttcaaaataattttaggaaaataaatgtataggcctggcacagtggctcatgcctgtaatcccagcactttggaggctgagacaggtgaatcacttgaggtcaggagttcaagaccagcctggccaatatggtgaaactctgtactaaaaatacaaaaaattagctgggcatggtggcacacgcctgcaatcccagctactcaggaggctgaggcaggagaatcacttgaacccaggaggtggaggttgcagtgagccgagatcgcgccactacactccagtctgggatgggagacagggcaagactccatctcaacaacaacaacaacaacaaaaattagagtatttaaaactaactaaacacaacttatttatagtggtataatatatccatttaatgttttggaatgccatgtctgcctctgtgaaactagactgttgggtttaattatgcggttcttgcttttctgaagaggtgaaagaataaaatatcttggtgggaggaaagtcctagactgagggaaggcatggaaatagtttgctttatttacaaagaactgaaaatgaagcgtaactcctattattgctgtataattattgatttggcttttctttttagccagtcaaatgacagctaagattccctaaataatagtgggaaaaaatatgttagtcacagcttccatctatgtgttgaatacacagaatgtaatgttttcttattgtgattaaacacataaagcataaaagttaccattttaactatatttaagtgtacagtttggtgacattaggtacatttaccttgttatatgaccatcatcactattggtgtcttcaggacttttcgtcatcacaaatgaaaactgctcattaaaaactaactccctatttcttcctcctccagcctccagcctccactaaccagcattctattttcctttttttttgagacagagtcttgctctgtagccctggctggagtgcagtggcacaatctcggctcactgcaagctccacctcctgggttcatgccattctcctgcctcagcctccccagtagctgggacgacaagcgcacgccaccacacccggctaattgcttttgtatttttagtagagatggggtttcaccgtgttagccaggatggtctcgatctcctgacctggtgatccgcccgccttggcctcccaaagtgctgggattacaggcgttagccactgcgcctggacaccagcattctacttgctatctttatgaatttgaatattctaggtaccttatatgagtggaaacatataatgtttgttcttttgtgcctggcttatttcacatcacgtttctttaggatccatatatgttgcagcatatgtcagaattttgattcttttcatggttgaatcgtatttcattgtatgtgtctatcacatcttgtttattcattcatgcatcaatgaacatttgcggtgtttctgctgtttcactattgtgaatgtactaatgatatacaaatatttgtttgagcctctgcttccacttcttttagatatatacccaggagtggaattgctggattacatgttaattctattttaaattttagagggactgcttcactgtttccacagcaatgacacgattttacatcccactagcagtgtacaaaggttctgattgttccacatccttgccaacacttgttattttcaaggttttactttgttttgcttttgtggtaacagctcttctagtgggtgtgaaatggttttctttcacaaatgaggtgaaacgtatagaagtgaatgtttcctgtcctcacttacccttggcttttatacttagcccatttcacatttcacaatgagaccactagactataagttctttgagggtaggaagtatgtctgtcttatttaccagtgcttttcaacttctaatataatgggtacttaatacatgctgaatgggtacatgcataaatacaagaatgtatgacaaaagtaaatgaataaacaaacaaatgagtacatcttagaatccaatagaaagtattgctaatttttcttttgttggtcaggcaagctgaggaaatttctaagcatcataaaaccccaaagctgatatgaaggggcttgttaggtttttctacttaaaaagcatacatgcccacaacagaaatattcattggcttcttactagttctaggaactcttctgagcattttgctgaacttatctcactaatcctcatgatagccctagctgctggctctaccttatgatgtccattgaagagcctccagtgatgtgatttgctaagaatcctcagctcttaagagtccaagtggagattggaatctaggtgtgtctgactctagacactaatctcttttagccagcataatatattgttcaccagaatgcctgcatttcattggcattttcttaattactgaaaagtaattaagaaaaggttaaattgcaatcactgcttttgatattccacaaacatcttacgttaaaatttaatgaaatcaaatagatcagaataaaaaagcaaaatgtcagattagctacattttagaaacctctaaaatgtgggaaagctgttctgcattccttttgtagctgtctgaattttgcaattatgaatgtgcattattttttctcatgttgactttcctcatgttatttataagaacaagagacttacatatagttgagcactttaaaatatctgttctgagcttagtgggacttaagaaaagctctcttccttccacaagtttttccttattgtctccacaagaatacttgaaattctcatatcatgtggtcttttggggtaaggatttaaaagcaggagtgaaaatgcaaatgtcatcccaaagagttgatccattaagccgttatcagccaccaataccttagcaggaattagttgattagaaaccaaagaatctagagagaattaactgtgtaaaaaaaaaatcacatactctagtaggccagaataagctggcacttatacaaacaaaatctagagacaaatttttggaaaaaaaataaaaatagaggtaagttgggacaaaaataacgagcaagtgtcaggttggccgcgaatgacaggaaagaagcaaggtgggctacttcagtcatatttttcttccacatcttcccacaaagaaaatgagtttccaactggaaatgggagaacttggcaagtatcagaaaaaagaaactggaatccacgataaagagggagagagcctctaattgcctgtgaaaggagctctcagcaaaggatgtagatcagtgatacaaattttaacagttaaaaactaaatcatacattctgtgaattcaacaactaatatagctggaggttgtgaccagtacatttgtttgagtgtccaggtcatccagggtcaataaaagtacacagcttctccactactgtagtcacaatggacggttcctcagccacatgtgtgcaaggactgggacgactgaatcgactatttagagggccgaggccagaaactacaggcaagaataagccttccatctctggaaatattataaaattaattcttaaactgataatttatcagcacagtcattaatgaagcaaacgggttgcactaagaataattccagaactaatttcttttaatagaattggtagttggcaagatcaagaggctttcactgacaagtaaaaatcattggagaggaagcccccacccttatacatgcatataccatttgaaataactactataataaaccagcctgcaggcgggtgccatattactcagctctcttggtgcagcagtggttgggaactggagagacacagtaactttaccatgatttttcagcaaggtctttggcaaaatctgtagttgaaccttaaaactctagttaagttaactagcttttccttcagtatgcatttgtaacctcaaattaaatagacacagaccaagaggaaaggtgaaggaatctgctgcttttacaaagcgaaggcacctctcctcatctgtctctaccttgaaactgcaatgaaaaataagacagaaatgggatgagaaaacatgataggatttccagtgactgttgtctggtgattaagggattgagcacccccccacacacacacacacccacgcatatacacacacaggtatgtataccacattctctactaccaccatggataatagagtgaatctgagttcattgaggtgaaggtgggtgaaccatcttttataattcttacacattataaaaatgtataacattcttataagttatacattcttataatttatatatacagtattaaaattgatatacacagtattataatttataattatacattcttgtaatttatatatacattcttataatttataagaatgataaaagatccagttttttatagaataatggtagaagttgtctccaaggctgctttattttaagaagacttactgaatgttgtaagcagctagttggtgtatttgtaacataagatacgattgccagaatcctggcctcatggtgcaggtgtaagcatgtaagtgtgtaagcatctctgcccagggaggaaagtatggaggagggcagagggcatggctctccttcccactcatgaggccttctgacatatcttctccaaactctggaccctagtcttgatatatggttcttacttagtatatctcaattttttttttctttaggcactagttcagatcgccatttatagttcttaatttatgctttacatcttcctctactcttttgttaggtcctttgtcacggtgcacttatgacatagaaatggtcaaccaagaaaagtcttcaagaggcaaccctaagccattactatgattcccttcttatgtaatgtttttaatcagtgattcttctggcataataaatatatttggcctttggctctgactcctggcacagagcccctaagacccttggagcttcctgagtggcaggaatgtcttttattggtcacaaagagtttcttttgatcacatccaacttagggcgaaacccctagaaagcctcaaaatgaggctggtcaccagaaagaccaaatgatgagagggttggaatcttttaccccacctaccaacctcctagaagggaagcagggctggagattaggctctatgaaaattcctgaatgacaagagttgataagcttctgagttgatgaacacacagaggtgctaggttagtggcatccccagagaaggtatagaaactgtgtgcaactactcccccggtgcctcccatcatgccttttcctatgcatttcctccttttacctgttcctgaatgtgtccgttgtgataaaccactagatacaaataaagtaccatcttgagttccctgagatactctagcaaattattgaaccctaggagaggtttgtgagaacccaagatttaaagctggttggtctgaagcattgatgggttggacttatgattggcatctgaattatgattttggaactgagtccttcacctgaagggttttcactaactctgggtagttagtatccaaattgtattgaattgttggataaccagttggtgtgtagaaagttgtagagttgctttactcccaaacttataacatccttctttttgccatcctaattggtatgaacagttttactagttgtacaagtcagtgatcctgttcatcatccttggcttcaccctgaactcctcatcaggtaaaaacctgaacatttggtgtcagaaatgctgtgattagagggatcgttattttccctactctgattataacatcaaactacgcttatcaaatttacagatgacacaaacttggaaggaatatctaaggacattatggaaaggttaaaaaggatttgaagagaaatgaaactatctgtattcaagcttcctttctaccactaactagtgggactcagttttcttataaaagagtaatgtttggccctgggagttgagtaaactgctcatacaactagggactagtgagtgactgaagcataatcagagcctaggtatatttgccttagcttttaaccagaatatcagagtggtccaagcaggaaattatgcacctgaaataaggcaatggcagtgatcatggaaagggatgacacagaaaaagactcaaaggactttgaggtacaatgttccctggtaaaagctaaagagaagggcctgaagaattcaggttgaagccaaggatgataaccaggatcgctggcttggacgactagtagaacggttctatcacttagaatggcaaaaagaaggatgcaaacatttggaagtaaagataaattctattataaatgtcaaaaaggagatttcaacattccttatgtaaacaccttgtatataattgggtaaataggtctaaacttcagaagagataatttgggagcaccaatacagcattagccgtggcaacaatagtcaaaactgtacatatgaatgagagtgcacagaatgaggaaccagcagtaccaaccaagcagtgagggacagcagcattaaggagtggacagaggagacagagacacaaatgagacttagaaaaagcaggtagagggatcggcagagaagcacagggcacggagtctatagaagccaccagaggagagagagagggtcaagcagttgcagaatttggcaaaggaggatataaagactcatcgagattactagaagtgttctccttttggccactggccagaccttgttcacttcttgccccttgttcatctcattgcccatggaactaaccaatgatcagttctcaagacttttccaccagtatcctcactcaggagtgatctcaccagctgcttcagtatctcagaaagttcccctatggtcagctggctttactgttcacaacatgtttcaaaacatgagattgacatgttttaaaaaagctgttctcagctgccctctccttattaaggtataccatgacatggctttggcaatagttaatgcagaaatactaataagaaatgagaacattgttatttgcttcaaggtaaataagagttggcagagtaataaagctgctcaaatacaatgttcggatgatcttacctcacattaatgaagaagggccaagaacacgggaaataatagccgtattttcttctacactggttcaactatatgtactatgatgcgctctattctgggtaccaaacttcaagaaaaataattcatttgaagatacagaaaagagggcaaaacggaaaacattctataagtgtttttgtgtatttgtttttaatgatgaagttatccattatagcaacaagttggacacattttcagaaaggaaggctcctttctgctttcttcatcatttctaaaaatgcggatatttttacttaccactcagaaaatgcctgattaacacctggagaggttcagtactggcaatccaaactgtttagcagggcctcctgggaagagcagagaaaatagctgaaaaaaaagagaaaataattctaatacagtaattatcaggtcgagcatggtggctcatgcctgtaatcccagcactttgggagaccaagacaggataatcacaaactctgaagttcgagaccagcctgaccaacatggtgaaaccccgtctctactaatagtacaagaattagccggctgtggtagtgcacacctgtaatcccagctactcgggaggctgaggcaggggaatcacttgaacctgggaggcagaagctgtagtgagccgaaatcatgccactgcgctccatcctggatgacagaatgagactccacctcaaaaaataataatcatcataattatcaatgtgggttggtttctatttatttatataggtggatttttcataaacagatttggaaaacactggcttaaaaacatgcaattttcatgaagcagggcctcctgcacagtctttaatatacaagggatacattaaatgtgaatgtgcaagggacacagtttctcaaatttatttgaccctttttggactgtcttgaggccatagtgctccccagaacacacattgggaaactgatctaggaagtgaaaagagaagaaggaagtggtagcacaagccaagacagatggaacttgttgactgactgccacataaagttcctgttccagagaaaacagaaggcatagtgatgactacagagagaatactgataaaaggcaaaacttgatggtgagaactctcggcgttctgattcttatctaacacattcacatttttatatttatttccattgatccatggtaaggctaaatgaaaggcactttaggcataataagtaagcattaaaatcataaaatagacaaaaataaaataaaaacttagtatattgtcattgaatgctaacagctacagaatctgaatttgcttgagagctgcatacagaaaatgaatccttttaaacaactttctataataaaagaaccaaaccactattgaagatagtagtaaattttacttaaatttttgaaatatcatacttgttcactttggagagatgactaagtaaatataattgacctagaaataagtacattgggaagttttcatatttttaataatcctatatattttttcaaaacaattggttaatagatttatcctagttcttctttattacctacttagagacctctgtacaaatatgtgcttgttaatcacataaataatgccataagtaatggaaaatgctggtgatttttagcaaatagaaaatagtaaaaatacaggcagtcatggactagagtataggcataactgttaggcacaggtaacaatatttaggacccaagtcatcggtccagggatgtgtggctaagatggaagaggtaaaacagggcccttcacatcaaagcagacttggatccatgatgagacacaattgttttctgtatgccaaagccatgaaaatctttcaagggctcatgtgcttgaattccttgaactcagtttcctgctagaatctctgcatttttcagtcctactcccatcttgactgccatcccaaaggaagatgtgtctaactctggtcctctcaaagctaatgtcttaatccaacacttctattctcccctttggtacatcaatccatcttttgtagttattctatctgcctcctccttcctcttcaacttttaatgggctctgatttccttaacttcacaaatatgcaaataccaaataaaaccccaatcatcccttgactttgccttttcttcacaggaattgcttgtctctttcttcacttagtgggtgaaattattggaaaaataaccaataactgttgactgtagttcttcccttgccatttatttcttagggaagcattctggctcttattatcatctctaataacaacaataatggagtaacaggcacttataaccataaatgcattccatagaagatagaaattgttatacagttggccttttcttctgaaaaatctcagtgggtttggttatgttcttttggagacaagactagaagtgaactgatctgcacaatttggagatcaagaaggtaattctagaggaaaggaatagcagagcacggaagctgagaaggagccagtgagattgagagtagataaccctctctgcagtgtgactcccttactgtcacccctagctgtctagcaaatctaactgaataacatgcataccatgaataagcatgttcgtgtgtgaaaacgagggaagggctagtttttctctcccaggttagtgttggtaaacaaagatacatatagggatattctcattacatatgtctacctcccttactgtgggtcttatttaataaaagaatgtttcttcagcgtttgttatccaaacactcattttattttcacaataatctcacagagtaccacatgctattatccctattctgcagatgaggaaattgaagctcagagagtttaagtggcttgccaaggcctacagaaccagtaagtggcaggaattcatattaccttgtacttagtaggtattcagtttatattaaatttacctagtttgagaggcagcatgcattttagtgaattggattgtgagtatattcatcaactcttgttctatggtaggatactgtcttaaatctaatatacaagcaaggactcatgctgagttaatgcttctaatagaataacctagaaatttattattttactgtggtgctgtcagcactagaaaaactttatttggtttctgtttttctcatttttgctgcaaataaagagaatagcctcaggaaggtgatttgcctgtcatttgatctttatgaagaaattacacataattaacttatttcatttttagtaagctactaattaggtgcttcgttgagattgcaaaggtttaattttctggcttccagcatggaagtaaaaaagaatccactatcatagagaaaacaaaatcatcaggagttcttgagcccccaaagaaaataaatgattgaacaaaagaatagcaatgggaggctttaatctgagcatttaaagagaaacagagacggaggaaatcttgcgatcaaagccaccaaatgaaaagagaaataaattatttatttagcagagggtaacatttttcttcgtgatacttatttttcttagaaatcaaacccatcctctctattgtgtcataatattttagatttcacagcatggattactgtactcttttatttttaaatttagccttattattcccaacaggcaacttaacatttaatatctgaaggtcattgctgtacaaatgtgatgtgaaaaaaaataaaatttagcagctgtatcatattatactaatcagaaaggaaggaaataaagaacaaacagcagtgtaagatggctgcagtgtggatgagtgagatggactaagcaattaagtattttgttgcagagagaatctgactgtgtattgtttttctcaaattttcagcttgtattaggtagagtcaaagagaatatagaagtgttgagaattaggacaaaattcagtttatcttatatgaccttcatttgtggagtaaaaagaacatatttcagaagacagatatgctagctcttgaatactaggtgattttaatagtattatgataattttattagagattatttacaatcaagaacctgagaggtttgctgttgttgttgccattgttgtttttaggaatgttcacagaggtcacattttccaaccttagagttttgctgcttgatttcttttgtatttgtagcttacgtggaagcagcaccatgctcagcacaagaaaagcctttcaacaggagtttaagcacagctatatgcaagtgaaattaaacagaaaacaatcccaatagtcctattcttcataagaccttaagacacttggggtttggtttaatttattgaagtctctcactcttttagcatatgggtgataatagtcaagagaaattatttaccatcatctactgatgaaaatcgtaggtggaagagatcttggaatccttctaggattggtaagaacatgaaggtttggggagatgaaatcttgctaaaattatagaactagttagtggcagagatatgattagagtccaggacattaaatatctagttcagtcctctttccactgttcacctctgagtctctgctccctcaatgctaggacccaactattgattatctcttgatttttaaagtgtaagaccatggtactgtttttcatagccacctacaattctctagaactctatggaaaatttcactggcattttatgataccaaccatggaaattccctctcaattccaaagggacattggcagaattttataattaagggccatgtctagtgttatcagccaagttatgtcccccaccagcttaaatttttttaaccaaaatgtcctctatatactgcaggagatagggaagattatcaattagggaaatggtaagaaaatattaaaacttttatttttataaaatttaccaatatcatgcacccacatcagtccacttgcataagtcaagagtgataaaatatttacacaacaatttcagtgaagcaattttattactcacagataggtagcaaaagacaagggaaggttaggatgtatggtgagccagcccccactaaggcacaggaaaactgccaagggcagatgaagtctcatctgtgcatattctgtgttgcactgcagctgagggccccccaaagcacatactgccctgggttttatacccaggggcaatggaattgctgagctaaagcatttcaggacaccctgttctgggaacaatgggaacagagttccagcctgttccttcatgtcttcaatgttgcatttccaatgtattctacagttactctgagaactacaagtgagaaaggggccatatggggacctgtcctgcagtgctgtgtgtcttctaagttagggtatgcaatataaaaaaaagtttgaacaacaatatcttaaaaccccttttagaaagtcagctgtagtcatgaaaaggagtgattctaaggtctctacaaattgttatcacaaaataccacatagtctccatcacaactccttaggtctctgtaagttgtcatcacaaaacaacaaaaacaaatcctatttgaaccctctgccatttctaggatgagcttgctcattatctctgaagatttacatggagtattcaaagcctgcagggtggctccaattagtatccattttgagcattggaatagaagaaaaataactctagtcatcagtaaaatgtccttaaatagttgacccctgaccttactgataaaatttttaaatctgcatgtcaagagaactgaccttgaccttgacatttgatggggcactgcatctgagtggttagaatttgatttgtggttttatatttagtctggaaaagatgaataggctactgtgttagttagttctcacattgttataaggaaatacctgagactgggtaatttataaagaaaagaggtttaattgactcacagttctgcatggctggggaggcctcaggaaacttacaatcatggtggaagggcaactcttcacagagtggaaggagagagagaatgaatgccagcaggggaaatgccaggtgcttataaccatcagatctcatgagaactcactatcacgagaacagcatgggataaaccacctctatgattcagctaccttgaaattttaaaaacttgaaatttttagcctaagtatttcttttcctcatgtaaaaaattcacagaatcaaataaaattacagtgattgtcttaatcacctttgaagagcaagggcagtctacactgatttttttaaaccaaatatagaacataagaagaaagagtgctctttattttattgtgaagtaaatgccctggtgattgttaataagtcaaagagaagtggttttgtcacagaactgttagaatttaagtagtatattattaaagcctattagatcaccatactccttttcaaatttttaatagtaaggtttcaagtctaatttaaactgaaaacgttacagagaataactaaaacattttaggagacttttttccatactaattagcattttaaatcagcctttcagagtacaggaaaaaaaactccataaaattttatttttattaagtgaaaactaaatattctgccaacacaaatatttgctaatatgtatacacatgtgtatgtagatatataaaaagtttggaaggacaggggccaaacagaaaatgggggtcttgaagagggctgggggtagggggagctcatatttatcatgcttctgtattatttgaatactttttcatgtaccatttacttaattaaaaattaataaaatcatcttaaggtacttgtatctgtattttaaatatatttattcaaatgtattttaaatgctgccttacaagaaatacaaacagcttcatataaacaattctatcatcattgaaatgtctactttgacaaattttgaattcacattcattgtttttaaataagttatattatttgttatttataaacaataactattgctattgctgtggtttggatgtgatttgcttccaaaaaaaatgatattaaaatttaatcccctatacatcagtgttgtgaggtggggcatagtggaagatttttggatccatgggggcagttttctcatgactaggtcaccctcctgtgggggtgtgtggattctgttttgcaggaatggattagttcccataacagtaggtcattataaagaatatgacttcttctttcattatgtgaactctttgtgtatgtcagctcctcttctgctttccaccatgagtggaagcagcacaaggccctcaccagacacagctgcccagtcttgaactttgcagccaccagactccatgagccaaataaacttttccctcataaattactcagcctcaggtattctgttattgcagcactaaacaaactaagacgagtactaaaaataaaatattcataggtgaatattgtaaaaattataaaagaaaaaattaaatattctgtgtatacagaaatctgagtttaatcaaagcaagaattttttttccttcagaatgtaataataatcatttaatgggcttatttccaagttttacttctctaaaatcaaacagtaggtccaatgaatgtaatgtgcttggcatatcctcaaaataaatttgcccatttgagaacatcatagagataatccagtaaattggccaaagaggtcatagtaagtgaaaaggcctaaatttgaactgagtcagcttagcttggaagctcttgctgtctctctcagataaaagctcctgcactgcagtaagcagctgcatctacataagtgccggacttttcatgtccagctaatctaccacattcactctgtcaccaatggcattggacacattctgattccaccctttctgtttcgctttggctaatagatccttttctagcctgcatttacataagagataaagatactatccagtagtaactttaacctgaaggtacagaaaacaattctgtgtgtccattatgtttgaatatcatgtataccctgtcaaagggcagcttcccttactcctaagtttaagggaatctgctcactggtcccctcacatgcaacaaggttgttctcttaatgtatgctagaaaggaaccatattttagcacaaatatgtgtcctttatgtaaaatgtcacacttttaaatcacaaaatacatacccccaagcaactccaatcataggaagctcttctatagatgattttctgtgctttttatttttatattctgtaggaatactctttaaccagataatctcattggttcagccagtacccaggcttctagatgctacatttgcacatactaagcaatttatcttggtcgtggacatgttcaactcatctcctcatagtatcttttgcacttggagaagtaggagctccttgtcaacctctagccattaaagagtcttctgaagtttatcttatatgtcctaaaaacacttatatgtcctaaaaacagtgacatattctgtcattgtaacaaataatggtaattattcattttctttcatatatttaaattgggataaagtttaaactaccatttcacactattttttcaacactctctccacattattgacagttcagctatgatacagtatacaatcactatctttttgactattgtctaaatactgcttgctctgtcagaaatgacctcctatctatctcctgaggttcagtttcaatgcctcacttcctatgaccttactctccccagctctcatcagctgccaccgctagatgctcctccctctaggattccataagaatttgttcatatttctattaacacatttattatactacttgagactagttatagacatgcctgcctcttccagcattgtgtgtttgtgtgtgtgtgtgtgtgtgtatatatatacatatatttatattataaatatagctctagtttctggggagaatatctgctccattgcagccatgtaaaaattgtatgtagacaagaacagaaaaccaaacactgcatgttctcactcataagtgagagtcgaacaatgagaacacatggacacagggaggagaacatcacataccggggcctgtcggtcggtggagggctgggggaggaatagcgttaggagaaatacctaatgtagatgatgggttgatggatgcagcaaaccaacatggcatgtgcatatctatgtaacaaacctgcatgttctacacatgtatcccagaaattaaagtataaaaaaaaaatttaaaaaataataaaaagggaaaaactgtatgtagagtgaataaatagattaaaaatggaattgtctgagaagttggttgaacttcttatgaacttttttcacaacttatttaggttgatacaacatggacttcaagagcctgaggttttagaatcagaaaatatctgatatgagctgagacttttattagcattgagaaattggctaagacttgttaggatgatcttgatcagtatcatctgatgattttttttttaatatacaactcctaccccaaacccaacaaggttctaatctaggctatcacacacacacatacacatacacacacacacacacacacacacacacacacaaatgctacaacacatctaaatataagaaaccatttattcatcttaaaagttgacttacattaatagtaatgcattaagtatatacattaagaactgtcttaatcagtttaggttgctatacattgccatagaccatgaggcttaaacatcaaacatttatttctcacagttgtggaggctataacttcaaaatcagagcaccagcatggtggagttcttgatgagggtactcttcccggtttacagatggccagcttctcactgtgttttcacatgactgagagagactggaagcttgctggcatctcttctactagggacactaaacctgccatgaaggctacactctcataacctaattatatcccaaaggtcccatctccaaatcccatcacatttgggatttcaacatatgaattcagttcatagcaggagcagaatgtaaataatgataatggaacatgcaatatttgctaacttataaggcttctaatgtatctaatttaaagacatatatttgagttttctttgatcaaagaaaaaatatgtctataaatgaatgtcagctataaaaacatttgcttatgatctgtcatttccacttaatgataataatgttacattgcatccatgctgctttttattttcaaggcaatttcacatacattatctgatttttcaactggtggccagtttaatgtcagaaatgtttccaagcttctatttatatttggttgtttaaagaagattctatacttatatgtggttacacatgaaacatacatttacttcagcacaccaaatcagtgaaacccgtagcaatttcagttgtgctcatccaaggacaaaattaggttttaggatttaacccaggtggcataataaaatttaaataacttgtttacctgagagcagcagcaacaaaaagagacaatcagaaatacaagccacaacagaacagtaatgaaatgtgatcctaaaaatattaataagtgttgaccctctgaaataaaataactaagaaaaggaaaaacaaaactaagggtgctcccaaagttgataaacaatgcatgaataaatgagcccctccactgtattccttcctttatatatataatacatatatgtaaaagtgatgtatatatcacttttttcacgggtcataaaatttgtatgttaataatttgcttgtttaccattctaatgtgttaaaaccttatacacctttgattttcccattgattactcttaagcagattaggcaatcaatacatgtttgttgaattgcactgaacttttaagcaagggtaaaatgatgccagctagaagcctatatattgtttcctgaatggtaagcagttcaaccaagaaaaaaaggtgaagcagatcgctttctttgctgctgttattcgtaacagtcgaatacaggttaccgtgtttttttcaatataaaatatggttgtcctagccataatcttggtctcgtgctaaatatattattcatgacatataatgagtagcttactttgtaaagaagatgtagtgatgttagcagtaagagtgaaattggccatttccccctcgtaaagctgtgtcttccccaagcaataaaatatggcttggttaagtggaacatgtggataaaaagatgaattgcccactatcttggagcctcattttaatatttaattttactttgggcacatcctgatacactagagaaagcctttatttacttttattttccagcattcattttgttgctctgaaatataccaagtactttactaagtgttaaattagttttaatattgtgaatataaagttttaattttatgaataagtttatagtactgaaatcactcagtgcggcaatgataatactgatcttggacctgattctcgattctcccttttttggcaaaatatggtgcatgggtgacatgacatttcattaatttccattcaccaggttaattctctattgcttatcttcatgtgagtgtgtgtctctgtgtcactaggaccacataaatgggggcatcaaaactacagaccacaatttcaaactgtccttctaaagtgaccagatttaaagatcaagaccagtcatttggagatgaaatgaagaatgctgataattatttattacctattacctgccaggcatcctatcaaacatatcacatgttctctcatttactcttcaaatcaacactggtgttcatattttgtagatgatttgctgaggctaagggaggttaagcgactctgaaaagataccatagctaaaaaatgtcagagatgagactgagtcccaagactttgtgattttaaagcccatgtcttttccactgactccaaagaatgagcagttgccagtagcgctgatttagaatcatcaagcagtcatgttgtctcaccattttctcccatcacccaaaattctacccacgcagctctgttattttagcaaaagactctaaatgctattaaaatgcagacaagatacagtgaatgataacatttaaagatatttagggtcagtccttttcttcttaggctgaccaaaagctaagaggataaattgaactggctgattaggcagaggtaacactaggaaaaaaaaatgtttagaaaactcgaaagacagattttaactgcttcataatttttctctgggctattgttattgctagtcttcagagaagcttgtgtggcacaaggaatactaagtgaactgaatgatctgaaaggtatatatcaaatgtgctgttaaagggtctttatacatagatggtaaaaccccatgataaaacttttgtagatacttcagcattatgcaaatgattgatcactttatgagacaattttgaataatatgtgtgaaattagttttctcctacttgtcttagttctttaaaggattaacagcatccattattctttgatgttattactgttaatatttttgaaaattagggactttttttaataaacgtacattaggatcaaaatatttcacatatcatctgattcttctgttgacctctaagtgatgatgatgtagttgacagatggtaaccctgcatatccaaatcaacatctctttgttttgtatgtgtcatgtagctttttattttgttactataattaaagtaacaaaattaaagatccaggttattatataaaattttcaggaaactatatgtctttttctagtttgacatgtttgtgtttttatccatttcttggtgtacacataaaatttaagtatgtgccatgggtttatgagccagtactcataatgcatcctgaaattttccagtggcagatataaatacagagctgtcatatttacgctgaattataaaacaactgaaaacaatgaaaactggtatattctgagtgggtggcatgttaaacccacacaattttgtcatgtttacttttatttgtactcgtttgacagcagggagaaagtactctgcttaaatctatttcgataagatagttttaaaactttataactttatgtaaaagcttacataaattccctttgctgttagttgattgaaaatggaattctttagtcacacataggtaattataaaatgaatgtccttccatcaacatatgcttccttgtttggatcaaatatatgtcttcgcatttgtagacattttcccttacttttttgttgaacttgtgaagtgaatgttaagtttatgtattcaattatgtggcgtgttacatacagaagttttctcccaactgcaagactttattttgctgggttaaaacacttggctaacatatggttgccaaagataaggtgcctatttaaaaactgatgttcaaaaaagctggtcagtgatagtttttttctgtttcattaaagacaatacatgctttctactgttttctttttttccttcagcagagttactatagaggaactatattcagattatttgtaatactttggaattacatttaaatttatcactgtatttccatgtttgaatgtcagtgagcatgtaggagcatcacatagttattttgtagcaaggaactagaatctaaccctcaaagagatggcaattttaagcatcctgtgtattcctatatgcttaagctcaagcttaattaattaataggccgcaaacagttaataggttaattttctacccattaattttacgaaatttgaaagaaatatttttgatagctgcaaaacgtattacatttctacaaaggaaaactaaatatgacattgtaaatagtgttccagacttatttttggctgtgtcccataatcgaagattttattttattttattttattttattttttttttttgagacagagtctcgctctgtcgtccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccataatcgaagattttaaagcattaaagtttattcatccctattgtcaatcctattctttctggctatattcatcagtcattgccttttcagtaaaacatattaaacatattaaagggatctgaaaacttacatgcaaatgagttgtgtgaatgtggtgaagagagagttgcaggatgttcagatacaattttttcatgttaattttatctcagaaacttcagggactaccacaatttacacagcaaattttaaaatttatagactgacattttgtttcttctttttatttatttatttaattttcaaccttcaaagagtggatctagactgacctttcaaactttgcgtagtctttttcaaatttatctttcaaactttattttccacttgctccactgctccattgctgtaccattgcttttatcacttttttctcaaacatgttactcttagtcctgtttttacttggttgtagtcactgttattctcctaaaaatcatgcattcattcattatcctattatgaacaaaaaatacacactagtcattgaggatataaaaatgaagaaaacatgaattcctacatggaggagcctattgtttagtggaagagatataattacagaggcaaggcactagggtaaaattatcttatctgttttcagattttgatgatcaacaaatcattggtccttccctataagaataaaggtagctattccacattaaaaaataaatatgagccatttgtggaagtcatcttcccttgatggtgagtgaatgaggagggtagttgtaggtcaatcttggtcagtggacttgtttgcaaccctaaaagagagcttgtgttaggacaaaacacactgaagataatgagtgaagagttgtgaagaatttgaattctatatgatgctgatgggcaccagagactaccttacctctgtatttcctcttatgtgaaaagattatatatatatatatatatgcatatatatatatatgcatatatatatatatatatgcatatatatatatatgcatatatatgtgtgtgtgtgtgtagcgtttattccaatttgtcaaagtattcttttgcttggatccaaaagtttcctaacttacctaagtaccattaaaataatcagatactaccagaagcaacctacagattcaatgcaatctctatcaaaataggaattacattcttcacagaaactgaaaaaaattctaaaatgtgtgtgggatcacaaaaatcccagagtagccaaagcaatcctgagcaaaaagaaaaatgccagaggctttgcgttacctgacctcaaaatataccacaaagctttagtaaccaaaccagcataatactggccttaaaacagatacatggactaataaaacagaatagaaaactcagaaattaatctacatgtctatacagccagctggtttatgacaaacatgccgagaacactcatggggaaagggtagtctcttcaataaatggtgttgggaaaactggatatccatatgcaaaagaatgaaactagacccccacctcacacataatcaactctaaatggatcaaaaacctaaatgtaagacctgaaataataaaactgctagaagaagacatagcggaaatgcttcaggatgtcaatctgggaaaagattttatgaataaggcctcaaacacacagataaataaggaaaatgagattatatcacagcacaaatcttctgcacaacaaaggacataatcaacagagtaaaagcctacagaatggaagaaatattttccatctactcattagaagattaatatccagaatatacaaggaactaaagcatctcaacaacaaaaatatattttaaaatgggcaaatgatctgaatagacatttctcaaaagaagacatacaaatagcaaaaaaaaaaatgaaaaaaaattctcaacattactaattatcaggcaaatacaaatcaaaaatcacaataagttatcgcaccgtcagtaggaggctattatcaaaaagatgaaaaataacaaatgctcacaagtatgaagagaaaagggaactcttatatgctattggtaggaatgtaagctagtacagccactccagaaaaaagtatggaggtcctcaaaaaactacaaatagcactaccatatgatccagcaatcctactaatgggcgtttatccaaaggaaaagaaatcattatagcaaagagatatctacacccccatgtttattgcagcactattcacagtaaccaagacatggaatcaacccaggtatccaacaacagatgaatgagctaaaaaatgcggtatatatacacaatggaatactattcacctattaaaaagaatgaaatcctatcatttgtggcaagatgtatggaactggaagacactgtgtaagtgtcaggaatagaaagttcaccaccacatgttctcactcataagtgcaagcttaaaaatgttgatctcatagaagtgaaaagtaaagcacaggatactagaggctgaaagagtaaaggcaagggaagatagagaaaaatttgctaaaggatacaaaactatagctaggtaggacgagtaaattctggtgttgtataccactgtaggataacaatatttaacaataatacatagtttcaaatagctaaaaagaggatattcaacatttcgacattctcaacacaaaagatgagtttgagaggatgaatacgctaattatcctaatctgaccgttatacattatatgtattgaaacatcactgtgcatttcatgaataggtacacttatttgtcaattaaaagtaaaattttaaaaaaatcagaaatattaaaacaaaagatactattagcagcttaaatatgaagggacctgaattctcaaaaagcaaaagtagataaaactgtgagaatttcaactctaaaaatatacttttcataagttaaacaatatttttccttgtgaatttttaagttcaaataatagtgacataggtgcctgctattttgtagggtgaatttcattaattttatgacacttggattccataataacctgtcaagatagatagaaaaaaatatataacattccaaattaaatgagaaaattgataatcctagaaatgtatgttatttgtaaaaatcaacattatagtgcagatatcccgcatttgattataagaactcttctcatttgtctatctgccatacttcttattggaactcagagctgatataataattctgatggttttaaaactatctgtgaacatatgtactaccctaccatttggtgagtttaaagtttggaaatcattaataaatgatattcccattaacaaaataaacatcactgaagatatatgttgagagatgggaaggagttggtgggtcaagagagacactcttttgtcctttgtccctgtctacaacaccattttgtggtctggctattatttcatagttaccactaccatctggaaagaaagattatcccacatgcctgggctcttaaattattgcaatattttttgcatgaataatgaacaaatttataaattataacatcattcctgttatgtttctaatatgaatgatattcacttgcaagtgtagggcctttgccctgattatagatgttagaaaagaatatgtgagaggtgttatagaaataactgaagtaagaatttacacgtttgttatttagtaaaagtcaatatatttctaaagacttgaataaaacaaatgcaattttgtacagaattcttcagtgcattttctaatttctcctctctgatgtgaaaataacacaagatttagaaatcacctgcaataaaacatgtttatttacaaagtgaaatagtttatgttgtattaacttaaattttcctatttccgatgcccaagtaatacccctctaagcgaatcatgattattgacaagtttacttttatacactttatagtactcatttcccataaataatgtatgattctttaataaaattgataaatattcaactctcaataaggcaaaatcctatgtattcaaaataaaatttaattgaacattaaaattcttgtctagttcccattttgtgtgtgtgtgcacgtgtgacttaggctgtttttcctgacatttgtgaagtcaatgagtttttctgctgtacattagtttctccccttcagtgctgccttacagtaccctattgtataaaatatgcattcagtagagaaaacaatatactgcagacatcagacttaaacaaaacactttttattgttgctttaaaaaccagactttacacccctgcactgaaaataggaactatttgttcctagtccatgtgcctggaccaaagcattttaaagtacctaaaaaaatttaaatttataaattcaggtttataaattgaccttattgaccaatacctataagtccttttaactttagaaaaccctccacaaataacaaatatgatcattttcatttggctatttttaatataaattaattttttcttacagaaaggaatgaaaagttttattaattagagcacttacttaaaccaatgctttcaagcaatctttctttggagtcagtgattatctttggctctataccaaaaacttcaggtattttttcttctttgcagtgttttaaaatgtatttggttgggtaaaagtcactgtttttaggtttcaaaatgtttctacaatatattaagccctgatatatactaatttacctctttatgatttgagtgctagattagttttacacctaataatgtagaaaaaaaatttaagcttataaatttgtatatattatactaatttctgaatataagcacaggtgatagcttattatatttgttcatatgcagctcctggaataatcctagaacaacgcatagtttataaaaaaaatagaaggggagtaggaaggaatgaaaggagagaaaaatagcatctgagcagtctgagaatttcacaataatagctgttctaaagtttagatgactataaattattcttaaacagttatgttttgcctatgtttaatatatataaaacagtagtatttgtatttctgtaattaacatttctctagaaaacagtgttaaatatatatttgttatagtctaaatttgtgttcataacatgtaaattgcaagcatgagtttagaaactcatgattttgccccctcctttaaaaatcagttaatcaataatttgtattgatgcactagaactccaagcaagcgtctcagagtgttctatcacaaagaattattaaaaggaaagcttcaaagctaaatcttcaatggtagctaaagagcagataaagactatatgaatctgattccccaagacaagaagttcttataaattaaaggcaaataggcaagtgattaggtaatatgaacatgtgatttaaggtgaaaatcttctttcaatggccgtgaataaatctcctttaaagacattatattgtgttcactaaattaaaatgtgccaattcttcaatgatcaatggcaatttgttttgctttaattagctgataaaacaaatgaataaatagcatcagctaaggtcatctgttctacctgttgctttaggttaatgtgtatttcatcctcagattccttagctctcagaaatttgactgacatgactcaaggaaataaaaatatttgaaatatgtatataatttataacataatgttagttttatgtaaaagcaattcagcaagtctgaaattacttttctgcaatgactataatgtaacaaatagaaataatttgtaacactgtgttctatgtcaattgtacttaaacacttttgagatatggcagaggatcttgcttccctcaggactaataatgtacacttcatctaagtccaaattttaattaacagttcttgttaagatagttttttctacctctaaacctaatcatacttggtatttaaatggcatattcaataaaagttgtcccatttcacctgttttgaagtcaaaggtttttgctttaaaacatttttgaactagctctacagtttttagaagctgtttagggacttcacatactatatgcaggagtaagtaactaattggtgctatactttatggtattgacacattcaaagaacttcattgattcagtacactttctctttcttaaaaacatgagacccttaaccatggtagaattctcattgttaatttattttggctgctctattgcctgttactaagttattctgtttcaagggcaaaagtatattttttccacatggaaaaaaattcaaaaccaggcagtagatagataaaattattctttgccattagcatgctaaataatagtattgcaaacagcagttcactatgcacagcttgatacgatagatgaaaatattagtttatgaatctgatacttaaactttactaagtaaagttagtaaagtaaacagtctttactaagtaaagactgggttctttaaagcccaacctttggtcttttgaatcgttctctatagcaattagtcactcatataaagtgagatattataaaccgcaactctgtttcagcatgtagaattctttatatatatatatagacacacacacacatgtatatgtatatatacatacatatacgtatatgtacatatatatatgtatatgtatactttaagttctgggatacatgttcagaacgtgcagttttgttacataggtatacacgtgccatggtcgtttgctgcaccaatcaacctgtcacctacattaggtatttctcccaatgttatccctcccctttcccctactccccgacaggccccagtatgtgatgttcccctccctgtgtccatgtgttctcattgttcaactctcacttatgagtgagaacatgtggtgttggttttctgttcctgtgttagtttgctgagaatgatggtttccagcttcatccatgtccctgcaaaggacatgaacccatccttttctatggctgcatagtattccgtggtgtatatgtgccacattttctttatccagtctatcattgatgggcatttgggttggttccaagtctttgctattatgaacagtgctgcagtaaacatatgtgtgtatgcgtctttagagtagaacgatttataatcctttgggtatatacccagtcatgggattgctgggtcaaatggtatttctgggtctagatccttgaggaatggccacaccgtcttccacaatggttgaactaatttacactcccaccaacactgtaaaagcgtttatatttctccacatcttctccagcatctgttgtttcctgacttaatgatcgccattctaactggtgtgagatggtatcttattgtggtttttatttgcatttctctgatgaccagtgatgatgagcttttttcatgtttgttggtcgcaaaaatgtcttcctttgaaaagtgtctgttcatatccttcgcccactttttgatgtttttttttttcttgtaaatttgtttaagttccttgtagattctggatattagctctttatcatatggatagattgcaaaaattttctcccattctgtaggttgcctagtcactctgatgatagtttcttttgctgtgcagaagctttttagtttaattagatcccatttgtcaatgttggcttttgttgccattgctgttggtgttttggtcatgaagtccttgcccatgcctatgtactaaatggtatttcctaggttttcgtctagggtttttatggttttaggtcttatgtttaagtctttaatccatcttgagttaatttttgtataaggtgtaaggaagaggtccagtttcagttttccgcatatggctagccagttttcccaacactatttattaaatagggaatcctttccccattgcttgtttttgtcaggtttgtcaaagatcagattgttctagatgtgtggtgtcatttctgaggcctctgttctgttctattggtctatatctctgttttggtaccagtaccatgctgttttgattactgtagccttgtagtgtagtttgaagccaggtagtgtgatggttacggctttgctctttttgcttagaattgtcttggctacatgggctcttttttggttccatatgaaatttaaagtagttttttctaattctgtgaagaaaatcaatggtagcttgatggggatagcattgaatctgtaaattactttgggcagtatggccatttccacaatattgattcttcctgtgcatgagcatggactgtttttccatttgtttgtttcctctcttatttccttgagcagtggtttgtagctctccttgaagaggtccttcacatcccatgtaagttgtattcctaagtattttattctctttgtagcaattgtgaatgggagtttgctcatgatttggctctctgattgtctattattggtatatagaaatgcttgtgattttgcacactgattttgtaccctgacacttttctgaagttgcttatcatttcaagaagtttttgggctgagacgatggggttttctaatataaaatcatgtcttctgcaaacagagacaacttgacatctggcttgaggagctttaagtgaccagatcatggccattgtttcgagtaaagtggaacccgtatacttgagggacgtggtaagaccaatgactactgggtaaataatgaaactaaggcagaaataaataagttatttgaaaccaatgggaacaaaaacacaatgtaccagaatctctgggacacagctaaagcactgttgagagggaaatttatagcactaagtgcccacaggagaaagcaggaaacatctagaatcggtatcctaacgttacaatttaaggaactagagaagcaagagtaaacaaattcaaaagccagcagaagacaagaaataactaagatcatagcagaactgaaggagatacagatacaaaaaacctttcaaaaaagcacggaatctaggagctgtatttttgaaaagattaacaaaatagatagactgctagtcagattaataaagaagaaaagagagaatcatatagacacaataaaaatgataaaggggatctcaccactgatcccacagaaatacaaactaccatcagagaatactgtaaacacctctatgcaaataaactagaaaatctagaagaaatggataaattcctggacacatacacccacccaagactaaaccaggaagaagtcaaatccctgaatagaccaataacaagttctgaaattgaggcagtaattaatctaccaaccaagaaaagccaaggaccacacgaattcacaaccgaattctaccagaggtacaaagaggagctggtaccattccttctgaaactatcctgaacaatggaaaaagagagactcctccctaactcattttatgaggccagcatcatcctgataccaaaacctggcagagacacaataagaaaagaaaatttcagggcaataaccctgaggaacattgatgcaaaaatcctcaataaaatactagcaaactgaatccagcagcacatcaaaaagcttatccaccatgatcaagtcagcttcatccctgggatgcaaggttggttcaacatatgcaaatcaataaatgtaatccatcacataaacagaaccaaagacaaaaactacatgattatcttaatagatgcagaaaaggcctttgataaaattcaacaccccttcatgctgaaaactctcaataaagtaggtattgatggaaggtatctcaaaataatacctatttatgacaaacccacagccaatatcatattgaatgggcaaaaactggaagcatcccctttgaaaactggcacaagacagggatggcctctctcaccactcctattcaacatagtgttggaagttctggccagggcaatcaggcaagagaaagaaatagcaggtgttccagtaagggaggaagtcagattgtctgtgtttgcagatgacatgattatacatttagaaaaccccattgtcttagcccaaaatctcttaagctggtaagaattctttatttagtatttagtctagttttaagaaagtcttctctcacctaccactattgaagttttatgggaacacaaatgatattatagtctaagtgaaagacatgttcatagtaggcttacaagaaatatttcatgaaaaaacactttgtactgtaaaatttgtacataagccattgaccattttttcatgagggaaaatataatgtcataattcggattggtattttagtgaaatggaaggtcgctgtatggcctcttcctcattcaaagtttgtgaaactctcttctcttttctttgaggctgtgtcttgagcaaagttttactgcaagttggaaccaaactgagatcaaatggccaccagttagtagtgacatctggaaagtcatcttctgtattgggaactcacctaataccacttgaaattatatccttgtctttcattcaaactctgacctccatctttctgattgtaacatagtcatcaaaacctgctaattgctcatcttcttgtaagttatttatgtggatgacctcagcgaatcttctcaaacattctatgaggcaggtactattattattctttctgggtctacccctttgtcctctagctattttttggagagctgataagtgaacttgaaatctgactacagggacttttctaataaccagataactttatttctctcttcttgatatatttgttttctgtgctcctgcatctagactgggtcgtgataaagctgagtccagctgtagggccagacagagccttcctctccacacagcattcttagcattgtggagctcggcttcaggaagcattttccttacttaatagaagctgttgctcctcttcatgggaagtcttggcaatgccagtgatctaaggtgatggaatctgttgatcctacatgcagcagcagtcggtactgaaatgagtaatattttaataatttttttttgccctttcttcttccagttttgctattcaaggtgatgtttcttagtcttctgctccttaattagcacctgttgactaaatggatcaacaaacctatcccacgtgtgacttactctcctggacacgagtcttgttttatagtctagcttagcagacttcccactggtttctgtcatgatactgtccatctagtgaacactttttttgttataatttcctccctctaaacttcatactgttaagtagtttctggagtgcaggatttttttctaaagtcagaacagtgggaaatgagttaataaagcttctacgttccttggaaagacccctgagagatacttaaccagttgcctgctgtgtaaatgttattgagaatgaaaaacaaaaagtaaatttacagcttctgttgtgtccacatccattccaaactagatgcaccataacaaaaataacacttagaactttaattgtagtatctgtgaaaaggcaccagtgtgatttatgtaataaattggatactaaaaactttcttatgatatcatgcatttaaaaattaggaaatgacagccctgaaggtaaatgtaacttgaatgatagcattttcccaaaagaaagcattagttttcaaataagtgtacttttaccaatttaccagtaaacagatcttgtcacagaaatacatacttataaaaactttggacatatttgaaaaataagcagattttcttaaacctcagtttttgggtggtcttattttcctcttctctataagcaaacctttgcccatcaaatagatatgtactttttaatgaaaatatcatatggtaattatattacccataaatttctcctatggaattttctagtaagtaggtgttattgtcacagaaatacttatttgtaaaaacataaagtaaattaatcattatatgctcattgagtaaacatagctgagtaataggttgcagtcatttttaacacaatttaacaaatgtttgaacgatctataatttttattcatgtgtgatttatggcatccattttaactaatgtaaagggtagatgatgaatattagtatcagtcaattccagacttcaaccttaatacacataaaagtgactaccaagcattttctcctaattaaaaaaaaagcaaattttatttattttcaatgaaattttagcttctaatagtcttcaaaagctatgtagttattataataatgttgccattcctcaaaaacattctcaggctgctttggaatcaccttaagcatttatttctgaaaacctattcatgtactccctaagcatagatgaacacaatggcctcatttgttaaagctgtttactccttgtttggtaaagctgagctcacaagtcaaaaccggcctgcagacatacggttttgggcaccatagtgttttctaaagggattttaagaccattaggcacatctagctcaaaggtaattgtcttatacctggcacacttcattttaaacttgcttaatctctagaaacctatgctttagttatccctaaacaagctgaatatttagtttacttttctgcatctcatagtgatgtctaataggcatcaaaatcactcaaaactgtgctcttaatctttgttcataaacctgttctgtttcagttttctccacctctgtaaatggccgctctattccaattactcatactgtaaaacttggagttctctttgactcaatcatcagcaaatcctgttgcctttatcttaaaagtatgagcaaaatctgctacctgctgtcccgagcccctatagctgtcacctcgctttactggcttatcacagtgatctttgaattcatctcccttttccacccttctttgcctatagcctgctctcagcacaatgggcagaatcatccttttttaaaacacaggccagatcattttaccctctccttatgacctttcaatgctccccattttactactaaagaagtcacatccttgaatcagcctttaaagtcctatacaacaggtccttggaatgtttctgacccaccccatgctatttctccttcattgcctctgctttaactgtgctctttgtttagcacactgggaacagtgctgccccaggatctttgcacttcctgttccttctgcctggaatggtcttctcttacttgctcacatggccacttgtctcctcttcttcaaaatattgcccaaatgtcaccttcttgatgaagccttccctgaccgccctaaagtagaaacagcctgccacccacctctctactccctaaccctcttttctactaatttaattattttttcatccaaaactcttacctctcctaatatgatatgttctttattcatttgcttattgttttttataaacaacataaacttgaatataaacttgattataaacgtgaaagttcaaagaattttgtctgtttttttaactgccacatctttggacactgaatgagtacctggcatgcagacacaatcgtatattaaagataggtgtttctttccaaaactcctaacaatcctagaaaactaaaatatacaccactactagtattcaaaacatcttgtttatgcatggcttcaagctttgacctaatttgtttatatatgtccctatattcagttactgttttcataaactttatttataaccccttagctttcatcctgtgtcttcatccttgtggttcagcaatgatatctagtctatatcttggtatataaataatcattgaatttttatgatatttcagtatgttaaggtctcctaaagttgaatattgtaatcttaatcttttatttatcccgtgtctcctgtgattcatatatttgaaagtaaattttaattctttctccaaaagtgtgttgaccataccagtccctatctttaaagacatgagataatttttcaatatttattgtgcatctgtaattgataccattggcttattttcttgattaactcttactactttagatttctctatctaaggcattcatggtgcttttttcactctttatatatcctcagtgtaccacattcctttctaccataaatatttcttttgaaaaaaaaactctctgtaccctctgtagatgtcacactgtgttctttctgatgtctccatgacccctatgtgttcatggatatttattaattttatatagtgactggacactccagtgaattctcaccagccatttcgaccccccacctgccattccaactccccatccctaaatgaaatcagcagagagaagattaaggccaaggcaacaaaattatatgaaaaggtatgtaggtggtcgcagaaggggtcagagaaggtaagtggtttccttgaacattaccaatgggttggattcatccattagaaggattttcaactgaaggtcatgaagcccaaaacaacaaccaaaggttatattataccaatgaagggtgtaagagttcacagacataaaggctggagattgtagaaagccaagaaaagtcaaagtgctggaacttatcatttaaagaaaaaaacctaaaatatagaaaaccaaaaaagattaactaaataatctggaagtccaaggacaagagctacacagtgcaaatgaatttggaaagcaattatgaaaaactttcctttaggatgtatgatcttcttgagagctgtatactcttttacctattctgaaaagtaccttaagctagcagagtccatgattttctgacaacaatgaattttatacattcttgctatatgaacactaataatataatgttaggttattcagttttgtgtgcatgctttgcaattttcaacaagatgttccattattcgatctgtctatcttgttcttgcttactcagagatttctaggaatgcaatctataccctgtataatttaacttttaagtcacgttgtgttagacaagagttatgccttatcttctcactaataataaagtgtcctaggattaattttattatttagtgcatagttccctagttgtatatattacttcacaaaaaacaacctcaaacttattgagtaagatagtcttattgagtaagataaacttacttattgagtaagataaacttgaatataaacttgattataaatttgaaagttcaaagaattttgtctgttttttttaactgccacatcttgagtaagataaacttactcaataagataagatagtcttattgagtaagataaacttattgagtaagatagtcaccttttttatttttaacaatgacatattgatgagtcaggaatttagacccagaatattgaggatggctcttctctactgcatgatatcagatggctaagggggtaactcaaaattctcaagagctggagctggaatcacctgacagcttcttcacttctgtgtttgacactgagactgggaaaggtgaaggatgcattcggctggaacagtgggcctgagccctcacctgtggcccttccaactagagagtctcaggctggttaagtattttatataacagtgcagggctccaagattgagtgttttcagtaaaggagtaagctttgttatggtttgttttgagactaggtctcgctctgtcacccaggctggagtgcagtggtgcgatcacagctcactacagcctcaaattcctgaactcaaacaatctttccacctcagcctttcaagtagcggggattacagttgcatgccaccacaccagctaatttttctcttactcttagtagagacaagatctcactctgttgcccaggctggtctcagactcctgagcccaagagatcctcctgcctcggccacacaaagtgctcggattacaggcatgagccaccacttctggcctaagctgtattatcttttatgtcctagccttagacatcacataatgtcacttccaccatgatctgtcagtcacagtaatcataaacattctcagattccaggggaagagttgtagactgggatggatattgaggcatttgtagctataatttagaactgccacctcacctacaggcatactgactgaatgttctttactcctattccttatgttatctttaactattacagtagttgctgagtgttatggagtgcatatctgtgtcccttcaaaaacgtcataaaacgcatacccaaggtgaagccaactctaaaactgcctgtcctagatacagtttttggaaacatggcattggagaattgagcctaaatggataaagaattactggcataatttttgtatatttccctaaggccctataaatactataaaatgaaatacagaagttaataaaaaaaattaaaaaaatcaagagtcaattgagttggaaatgacttcaagacagagttgataacaatatatgctttatcaaagagtctattcagtgatgactgaatcagatttatactgatccatgaatttgaggtacaatcaagatgaaaccctcacctccaatgggtcagtgggtctgaaccttcacctgtggctcaggtgatagcatccaacgggatgctaatacgtggtgggacctttggaaggaaattagattcagatgatatcatgagagtgtggtcctcatgatgggattagcactcctataaaaagagaaggagactagagcttactctctgctgtgtgaggatatggtgagaagatactgtcaacaagccggaatgcaggccctctcctgacactggatctgccactgccttgatcttggattccccaactctgaactgtgaaaaaggaatgttattgtttaattcattaactctatggtatttcttcatagcagctcaaactaagacacctatttgtaaagagaatgtgactgttatttgtcaccccgtataaagacagttacacagtttaatgattatttccatatttttctaactgcacattagctgaggcataatttttcttgtacacattcttttttaaaaatgttctctttattctgatcatacctcaaattcatggatctgtataaatctgtatgattcagtcatcaccaaatagactctttgataaagcatatattgctatcaactcagtcttggagtcatttccaattcaattgcctcttgattttttgtatgttttctattaacttctcattttattgtatggcatttatagggccttagggaaatatacaaaaaaagtaattatgccagtaattctttatctatttaggctcaattctccaatgccatgttttcaaaaactacatctagcacatgcagttttagagttggtttcaccttggatatacctttcatgacattgaaattatataaatctttaaataagctttttgtgttatatagacctcgcttgtttctgtcaacagttggcgtatgctagtttgacccctacattgtccaagttattaaataacttgtagaagatcactgaatagaatacatgcttgtagaaaagaaatgcacatcaagtaagattctagtagtttttctttcccttatggttaacagattttaagatattatctctcatcaaataatcatgttgagagcttacattatctttttatattatctctttctatttgcttacataagctagtctacatgctgctaagaagaatgtggataaaagatccaaaatacttggtaataagtattcattggaaatgagtgtcactgtgtaatattgccaactttttctagttttgttatttccatgtacacactgaacacttagaaaattatatgtgtaactttaagtatttgttcacatatcattacatacatatacaattgtatatcagctgtcaacctgctatgatgttttctggtgttaaaagggactcagtttcttctatgtcatgtgaagaaacatgctgtcatccatcagactgttttacatttacataataaatcatgaaattccagacagtgttcactcatttatggttggtcattccttgatgttaatggaagacaaggcttatgagaatatttcacttctttaagttctgttggttaaaaatattcctaaccagcggatcacaaggtcaggagattgagaccatcctggctaacacggtgaaaccccgtctctgctaaaaatacaaaaaattagccgggaatggtggcgggcacctgtagtcccagctactcgggaggctgaggcaggagaatggcgtgaactcgggaggcggagcttgcggtgagccgagatcgcgccactgcactccagcctgggcgacggagtgagactcagtctcgggaaaaaaaaaaaaaattcctagccatgttaaaaattactttggcgttttaaaaatgtttaattttgatatactatgtcacaggaacaaagagtttataaaagaatttgtatttttttaagtaaaagaacccttataaccaagagccaattagagatgttcttctagcagcatatagactatgtaagctagtgtgaatttgggatattttttgtcattctttaatttctattctttacttagtttttcctgtttttaaaacttatatgaataggccgagtgcagtggctcatgcctgtaatcccagcacttgaggaggcagaggcaggcgaatcacctgaggtcaggagtttgagacaagcctggccaacatggtgaaaccccgtctctactacaaatacagaaattagccaggtgtggtggcgggtacctgtaatcccagctcgaacccaggaggcggaggttgcagtgagacgagaccaggccattgcactccagcctgggcagcagaggagagacactctatctcaaaaagaaaaaaaaaaaaaaaaaaaaaaaaacaaagaaacttatatgaatagaaatataaagtcgttcctattgtttctggctattgtcacacattatctttgtcagatgaatgtttgaattaattaataaatattttctactattctatttcccccatctttttgaatgttataacttcactttctattattttagtggttaccctaaaaattaaaacatggatatttaatatgtcaaaacattatcagtctctttactcacctcttagatatttcaagaactttaaaacactttctagatttacattatagtgtaaaatatatattctagatttttagtcttacaaagttatatttcctattttataattatttgttcatttctatcaacatagtcacccactgtttcccattgcttctagaatctcagaaggaaacaaaatcctttagaatttcctctacttaatgtttcttgatttttgtttgtctggaaatacattataatctgttgctgattttcctagttcttgaattatttgccagtctgttctgctggctttcattctctttccttaaatagttggccgttttttattcggcactgattatgatgctgaaataattatttgtgtgaattctttgaagtctatggtgaaggtcctttccttcatcaagaattttcattagattctcctgggtacctggactcacagtcattattttagatgcaaatagcataatagtcttaaggctattcaggcgtgctgttctttgtagatattatatcacaatctgtacttttatcccattcattagatttccaaaattttacataaagttcataggattctcattagctttttaatctggaatgaatctaaagttttgcctccacttgagccttctccatttttttctttatctgtctcaatggagatttgtcttatctttccagagaatatgttcttagactcactcattcctctcatcagttttctattttagtagactgtaatttttttcataattttcataaaatctaattttctcataatttccttttctctgccttctttgtattacctttcctttatttcagtagagtataaattttttcataaaatctaattctttcatagtttccttctctctgccttctttgtattgacttttcatttttgttacttcttaagatgaattctcaactgatactatattctttatttttagtataagtaaaacaataaatttcacttaaatcttctcttccgttgcatctcacaagttttgttatgcagtactttcattattgtttagttatgttcagtatcttttgatatccacaatcaagttttattagtccaggtatgtttttaagtgattttttacgaatttgttgcacgcacacacacacacacacacacacacacacaccccaatgtttattagtgatttctaatataattgcattataatcagagatattcttagacattttagagactcgcaatataatttattatatatccactttcgtaaaagttccatattttctggagcggactgtatatttcctaattgtcggccaaagaattatttatatatctttagatctcaaaagtttaggtgtgaagtttattttttattgtaggatcaaacaagttaatttagttcacaaccagcctggatgacatagtgagacccggtgtatacaaaaagcaccaaaacaaacacacaaaagataatttaacatggtgaccactctccaatgcattgttttaattagtttttcttaaaaaccaactttctcctgttgctttatttttgtaaatgtctttattgaagagaggcacatcagcaaggaaatagggccacatcctattggagggaattccgagttctaaaatgcacctctacattggcagagaaatgacaaccagttaatgaaaacgagtgtttggcagctgttgtctcctttgcctgaggccgttctctagtgtcacagcagggtaaagatgtgtgaaaagttgtatgaccagatggccatgagatccagaatgcctagaaataaaagttctaattgattctgcaaaagagaacttttaaaattgctataaggctagtcccagcatgatccagtacatgattaaagaacataataatattaaataacagcaaaactcaaagcaggaagaaagattgtcccatgctatcatgtgactcatccacacaacagaaaaggcaaaacacactcagcaaatggaagaatttaccacccttattctggccactcatcacctaaatgaacctaagccattccatctcaggactgtgccagttatcacacttccggctccagttaagagaatggtgggcaaacactggttaaacaatagagggtttttgtaaattatcatttttaaaaaattttatgagaagcctgaaaagtgggaatcctagatttggttaatgccatggaccattggtgttagacactttacttttcactctaccatctgtaatgggctaacctttgcggtcaggtccttccaggcatggttgatctcacatagccacatacaaggatgaggaaaagcctttctttctttctctctctctctctgtctctctctctcccccccctccccctcctcctctgtccccctccctccctcccttcctctctctttctctccctcctttcctctctctctctgtcacacacacacacacacacacacacacacacacacaaatatacaccatcagtgagaagtatcatgccagaatccctaacagattttattttggatcttattagtcaggattagtcaccatgtgctagctacatagaagcctgggcagggaagtctgtgacaggttcagggtcattctggacagctggtcaactctctaagcacagaaggaggtagaggacaattgagtagggcatccctgaggatattctgaagaatgtcagttgagttgtgttgggtttggttttctgtctccctgcaaacagtggcaagcctggaaacttgctttagctcttaaatagtacttttgtacttacttgaaatatagagtgtctaatattttgaggcatttcaatgatggcagccttgttctgtagatgttacagagagataatgaaacactcccactgcttggttcctgtccttttcctctgcccacggcccggtcagagctggaagggtcagtctgagagcaggagcagctctggctactgcaacctttgggcaaatcacttaacctttttaacatggaagtcttcattaaaataagggcatgcatgtatcaagggcattgtttgacttatgtgattatctcgcagttgcttttgccaatcacatctttctaaatacaaaagagttcctcttattgctgaagcacccagctaaaacagagttggtatttctcacaactcattcagtgtaattaaaaacaattaatagatacctactatgtataagatgccaacatgaatagatcatagttcctttccttggggacccacagtagagatacagttattgaaatgtaaatcaatacattaaaatgcaaaacttgtggaaggcagagaagtagcagaaaggagggatgctttgctgaaattaggtcacaagtagtaacttgctgagtttaaggacttttggactatggtctatacaacggaaaaaagtatgggagactttgaatactttctaaccacgttaaatactttataaccaggttattttatagacacaaagtaaaggatattttataaccatgttagaacttgaaaaagcacttgctattttggatttagtttattccttcttcttttgtgactctttatttccagcatcgtattggatatcttctcatgaagatggcataggcctttcaaactgaccatgtccagaaccaaactcattctctgtctcccccaagctaaacgtgtctcatttgtttttggtgcaagttactgacatgaccatgaacacagtcaccaaatagaaactaaggtttgttcatgagacttccctcttcctctcctactacacacatccaccagcatgtacgatgaattctatagtaaatcatttctcaaaatcgtttctgacttttctttctcgctcccttactctaagtcaagaatcagcagtctgtttttccataaagggcctaataaatattctcagttttggaggccatatggtctctgtcaaaattactcacctctgccattgtagcacagaagcagtcgtagacaatatgtaaatgagggaacatactcctgttcctcaaagttattatttctaacaacagattgcacttggcttaagggtcatagtttgcccatgcctgattgaggccctcctcaactttcacctggattaatattgcagcatatctctaattggtcttccaggctttaattctgctctacaatctcgcctttgtatttacctgcataaataacaaatcgaattcatactgtctgtatgaaaagaaatcattgcccataagaaagtgatatttcctagcttgtcacacgtggtcggtccttgcggacttagattcgtgtggctctttgtggcttcctgttccagcccttgttgcttcctgtagtcctcagaaattctgtcccttgcctctccccaaacacagtaacatcttccgtatttcctacatggttgcagttgtcacctcagtgtatgggtcactcacttatatgtgcatactctgtgtgcatgagagtgtgtgcgatttgctacagattttaattaaaaatattatagtcatatgcatgattatatttgtgtgtacttaaatatatatggaagaaatggacaatgacgtgtccatgacaacagagatactgtttccgtgcatctgtatttgataaattcttagtcatcttttaagacagagctattttgtgaagccacaccacacgtccttggggcagtcattgtctctctgagcaccctttgcacatcagtcgtttcttgtctatcacttgcagtggtgtgctggagcttgcttagactggctcaagaaaactgatggttaaattttcaggaattccgtgagtcgcttgttaaattgttgtaacttgaaattaaccatgatgggagtatctacaatagcagatgctacaaaccaggatgtgtttttagggtttattttgttggagaactggttgaccagcacaccactgaatctttccttttctgatcgacaactatgtaagacaatatgcctaatagatacccaatatatagatacataataacccttaatccttagtatgttttagatgactcagtagacttcctgactactgtctttaccaatgttctattagatgagatcaaaagatgcatctttacattgaatttgattttagtagagagaatcacttatttttttaattagaaattaagctgcatttagaaagttaaaaaataatgattactgattttacatttaagtcaactttcaatatgcttagtattaccaattgttactttaataaggtgtttttctgggaacattgcttataaaatactatttatatgtttttgtttgtttagctccaatatcaaagagaaatagctatattgcatgtgctataactgactgtcaatgaatgggtaatttaaaatagcctcagatgcctcaaaccttaacgctaaattcacctcacaaagggaatttattcaatccaaacgccctcctattgcttaaatgaagacattgatatgaagattcatatctgaagttaagatattagtaaatcaaacaatgtaaaattcacgaccatatatatcatacggatttggaattagctgagtgatctacttttgtatatttttgtggttaaatttaagcactatacatttatgagaatgattttctaagaagaaaccccatttattttctaagaaattgcagcctacctttctatgctggtttgttttatgtactactattgacttttcttcagttttatataagatacacagcctagtgaataataaaaaagtattattacatttactttaactcttagcctttgctttgactgcacagaaggagacctttaatttttatatgctttgaaattcatgaaaattgacatttttgcctgacaacttatttctccactttcatatgcctttcctcttgactgaatttagtcttttgtagtgttgcagaggctgtagattaccaagttctcctagattcacagggcagtaactataggcttgaagaacattcaccactaaacctgagtgaggctcattcgatgttgtaagaaatagagggctcatttgttccctctgacagcctctccaggggtgctcacttatgtgtacatgcactatgtatacatgtcctatgtgtatgtatgagagtgtgtgcattttgttatgcattttaataaaatatagtcatatatattattatagatgtgtatatacataaatacatatggaggaaatggacaatggtatgttgtaatgttcagaaatgaacaaggtgatgtaaacactgtccctaaatcttgtttcacagtagagtttccagtagatgacaagtacggtagccaccacaaagggctgtgagagagagggtgcatctctccaaaacaagtattccccacaacacagtgacagtaggctaaaacatttcgaatattttccctgcctgcttagagaaagcatagggctcaggctgtcattccatgttacagtaacagttctcgtttaaattcattaataaacaagcactcttctaaacttagctaatgtgctcttactcctgaaagataaagaaatccagttttgggatgctgacaaagtgagtcttctgagcctattagagtaaaaacagcttaccctagtgtaaggcaactataactgtaagatcatgaatgttctcgagagaccacttaaggacagacacaggctattctgggcatattttaatgtcctttttggcctttctattttaaaacatttcatctttcttgtgtgtggctcctatcattgctttcctaagtttaagttggtatattcaactgttcattcctgaactctatcccaggaacttttttctcccactcttaacagaagtcaagagacataggtcaattttctgtaatttagtaagtaattcagtagcactcaatactcagtatcatcatttatacattataaccattataacatttattctgcacatctaagtttgctttgaatgacagaattaatactaagagaccttgtctcccttgaaaattgatgggaaggaagctttagccagataaatacttttttaaaaaaaaatgtcatcaagtgagagagcctgaaccacaatcccaatgggatcagaacacttgagtcaattagccaagactccacctacctgtgcactagtgatggcccagccaatggaaacccactacttaacatcctggcaaagctccctgtctatgggcactgcttaactgggccatatcctcacttcctctctgtctcccctttctttttatgctttctttgctgaccaagcccctgttcacattctttcctatatttgttaatatattccatcacattattaaaatctaactgatcgtaccgtccagggacacatcgtgtccctcgaagacttgactctattctaacccgttattgttaaaattaactttcaaagggcaattagcatttgtaatttcatgaggaatagtcaaatagcctgaaagtaatatcaacaggctctctctatttagaggggcctcactgagaaaaggtaaagaatttcccgttttaacccatgatggtgtttgtaacctagaatgccatttttacagcattcaaaatggccagtttcaaggtggctgacgtggtttcggtgattcatattatcaaaaaatgtctgtcttactagatttttttaaccagaagttgatgtagttttaaattttttaaactgccatttactatgaattttaggtaggtgcacaaataacctacagctttgaactttctgaagtaatattttcatactttttacttcaaatgtagaataattttttactggttaaattattttgacagcttaaacccaatgaaagagtatatgtgtatatatttatgagaacattgaaatactgtttgagagtaattatttataacagagacttctggatttgacaaatgttatcattgtcttgagaactgtttctagttgtaaacagtaaatagataatactgtggtcagaaactttcctggaatttagtagtgtttgtatgaactgtataccactgagaaccagagcagggagaactttagtttattatacttgagttctgttttttctgtttgttttttgcttgttggtttggtttggctttcatcttgtaaatagtaaataattatatttcatctagcacatttttatgtatagaagatatacattggagatggaataaaaatataaactgccaatattttacttatacttttgaaaagatgacttgttacagataaatttatcaggaaaaaaaaagcaaacatagactgcaaatccctttgttttatgtgtcttcctaacagatgatgggagtttagtctaaagaatagaaagccatacggacaataaaactcattcacagagatgaatctcgaatatttcaataatattgcatttggattggaaactgtaaacaaaccttcagactgcaattcaaattttacttttattttttttcttacttaaacatatgtacattatattcctatttctcaaaaatatgactaggaaggtaaaaagcaactaacgttatagccttcttataaagaaatttggccctttatgagttcaactaaatagctaaatgtctacttttctatttgtaacatgtttttttcactgttaccagtaaaaagtcatttatttataggcctctttagatatttgtatttttcttcaaccacaatttaaacattcatcttcaaatcttgcctaccattgcatttatttgaaatcgacacttgtgttttagttcatttttaataatctgaaccaaggcttctgaatcatttatccatatggttacatagtctaggttatcaatgcctgtgcatatcatactgtaaagtgctttgaagatgtgttcatctctaggtgaagcttgttggctgatggatttattaaatgatttgtgacatagcatatcccttgttctacccccaaagtcttccattgagacagtatgcttcctccagaggaggagccggtagtctctggctatattctggaaacataggaaaagaggaatttcccttttttcttttgaggggcccttttcctggtgttgccttaaaatatttttgtcacgtcattttcctcagtagcagtgagcgttactgggtcagagtgttactatacactcagtaatttcacacatatttactcagttcatccttgatatgatttggctctgtgtccccacccaaatctcatctcaaattataatccccacaggttgagggaaggacctggtgaaaggtgattggatcatgggggcagtttccccgatgctgttctcatgatagtgagttctcatgagatctgatggttttatcagtggtggttttccttcttgctctctctcacctgccaccatgtaagacgtgtctgcttccccttccaccatgattataagtttcctgaggcctcctcagccatgtggaactgtaagtcaattaaacctctttcctttacaaattacccagtctctggcagttcttcatggctgtatgagaatgaactaatacaatcctcatgatgatattatgaaatagatactattattttctctatttaagagatgatgacaaactgtgagtcacaatttttaagtaactcagtaacacaactggtgtgatttgtgttactgcaaattactgtctgttttacagtaacattggtaattatgccattttcaccccgacacaatttcaaacacacccttccccaccaaaaactgaatccaattgagattcccagttgcagattctctgataattactcttgcaatcttttagggaggaacagaaggttacatggctgccttgagtggtgtagggggccccagccaatctccaagttttatcttctataccttacattctgccgcttttcatgatacattctgcctcttgattttgagcctttctggcattgagtggtgtagctcacctcgcacagatacctctccccacaagtactaaagtagtttttcaccatttccattttcacttctcatggacttcattatctttaaaaacttcattgaaatctctcacccaacagttgtactcatatttcgttgacgtttcagcctttatactttttaaaaatcagttcactcttactttggtgagttttcagaggcagaggaagcagaactataatcaactaatcaagcccctttgagccagcagttcttccaggtttgtgattcacagataccctggaagaattgatgaaggcttctatcatctcccctagaaatgtgaagacacaagatattctgtatgacattggggctgaggatagcttttgtggttgggaagaagtatgataatgtgtggagttttcccacatatatttaggaactttactcttttattaaaaaacaaattaaaagttgcatctgttaaattttctcttacaaaaacatttatggattcatcattaaacatacatgttttggaagcttagtatttatcacgtttgtatgataactcggtagtgagagcacagagggcagtcccagtgttcagagagtttatggcagatagtcgaaggagagaaatgaggaacaaggaagtataactgtgtgacaggagactatcatacaacttatgccctgggtgctactgaagcactgaggggagggacctagcatttggagtaagaaacagtcatcagggaaggtttcatcgaggaagtagggttcatatgttttgaaaatgttatctatttgaacactctgttatcaggtacagacatatttagaatttttctaacttgtagtgaattttaccttttttcattgtatactaaccttccttatctctcagagcgcctttttccttgtgttgtcttaaaatattttttgacacctcatttttctcagtatcagtgagttctctgtgcttcagagtgttattctatgctcaataatttcacgtgtatttactcagttcatcctcataataatactatgagatacaaaccattatttcctctattttagaggtaagaaaaaacatgatgcacaataacttaataacacaactggggcaataaataggatcaaattcagacaccagcaccttgaagcctgaacctctccacacagtaacactactgtatattacaaatgatctcaatacgtttatactatagcactaagattggtatatgattgtaaccatactaattttctttttcttaaaaaagttgtatttgccttagttacctttctcaattcttttactttcaaattttcttagttcctgtgtgttagacatgcttctcagaaatagtattttgctagatttaagaaaaaatcaatagttctgtcttttcagtatagtatttcttaatatatttctaccatcttattttgctttttctttttgattttcctttattccttcttctccccccccttttggttgatcaaatatttttaaaatatcgatttcccctacaattgctttgaaatgtatgtatgtcatatctagtattttagggattatccttattttttttcaaaaatacttattaaattccaacatagcttaagatcttgatctttctcctgaacataatcctaatcacagtatttgaaacttacttctaatcacaccctatcatgctatagtctactttttgtcctgagttttagttctcttttttaactttaatattagtcattatcacttttataattttagtttatgtagtcaatatagttttagattttaccacatttgcatatttcttctgttattatgtcatcttgtatttctctcttttctggacatagttccattctttgacacacatcctttagtttagatggcttttaatgggaatgtgttggtactaaggtgcttctatttttacatttttaatttaaaattttttcattttttgtttttctgaaaatatcttaattttaccatcttccctgtttatttagcttggtatacaagtctatgttgaaagtttagtttctctcagtactttgagtatattatcctactaaattctaccttttgttttcacttttcttaagaagcttcctgactgttttaaaattgttccttagggatactctctcttttctcccttgctacttttatgttccgtggtaatgtgctgttatagcatgctgtgtttagtgctagattacctttataaaaatgtttaattgggatgtattgtcctttctgaatctgaatttttaaatgttctggaaaattcttagatgttacgtattttaattgattctccatcattctcccttttctctcctctgaaattctattaatattgttccaaaagtaattacagtttttgtcattacttttaatggcaaaaaccactattacttttgcaccaacctaatacgttagaactcatttttatactgtatattgtagaatttatatttaatgtttctaagtttttttaaatttctgaatgacattgtcgatattcaatctacctttcagtttacaaactcactctgtagctttgtctcatctgcttaatgcaactaatgagaggtttttttctttaaaaaaatttaacttatattggtatataataggtctatatatttatgggctacataagaatgtctaataattatatcagggtaaatggggtatccatcacctaaagaattcatcgtatacacaacagagtactattcagccatataaaagaatgagatcttgtcatttgcaactacatagatagaactgaaggacattatgttaagtgaagtaaaccaggcacagaaagacaaactatgtgcgttctcactcatttgtgggagctaaaaattaaaataactgaactcctggagatagttgaatgatggttatcaaaggctgggaaggatagtgggtaaggtgggaaatggtgacagttaacggttacaaaaatacagttggatagaatgtgtaagatttaatgtttgatagtacaacaaggtaactaaagccaacaatattttattttacatttaaaaataactgaaagagtccagttagaatgttcataactaatgcgtttttaattccaataatatatttttaattcctggagtatccatttatttccttatcaacaatgactggtaatttttaagtattatttgatatggtttggctgtgttcccacccaaatctcatcttgaattgtagttcccataatccctacatgtcgtgggagggacccagtgagagataattgaatcatggcagcagttccccccatgctattctcacaatagtgagtgagttctcacgacatctgatggttataagggactttccctcacctttgctctgtacttcttgctgcctccatgtgaagaagggtgtgtttgcttccccttccgccatgattataagtttcctgaggcctccccagcactgcagaacagtgagtcaaacctctttcctttataaattaccagtcttgcctatgtctgtattagcagtatgagaacagcctattacagtatatcttattcttttcttgtatatttaattctcattttacttcaaataatttatgaatgttttatttctcaatccccaaatttagctgaaattgaattcatgggggccaaatattccatgcggtgtttctgctgaattctgttcattatacttgttttcttgagttttatatttttggattgtgagtttaaatttttcagggctttgtcattagtaatcctataattccagagtgaatccagagaggggttacactttatttcaaaagataccagcttggaaccattttttctattttaagttcttgatttgggggttatatccaatagtcagtgtaaattcaaaagctgtaatttaattcagcaagtttatggcttatgcattctcaagaatcatcattttttttggaaaaagataaaatacagacaaatttccttgtcatccctctttgctgactagttaatttttctccagtgtctgctttactgtgaatttagcatttttaggttttatgtggtggggctaggggcgtgagggagttcctattctttgcacaggtctattacttgatttctaattctgtttggccttgaaatccaaaattctgcattgtaaagattagtaaataccctctgactactatagcccaccatcagctaacaccctgaatttcagtgttctctttttttcttgatacccaaaagcttctcctattttactggatgctcagatatataacttaaaagatgtatgttacattttatttagcatttctaggtgtttgaaactggaaaattttcaggctcccatgttgcctcgtcctaggaaatgtaatccttagagattattgtttctgtttcctattatgtgatgtgacattacagaatgttaagtattttaaataaattatcttatatcagaaaatttatgttataaacttttggggtgcagttaatattttagaaatgttttcagatacaaaaagccatgttttaaaatatctcagaatagacattataatcttgaaaaaaaaaccctgatttttattgaagggttttgttatgaatgaaatttggaggtgctcttgtagcattctgcatttacattctagcatcacgcttcatcaataaacatgaagacatttgtataacatgtaaaaccatcttatttataccaagtgcagaaaattgaaaagcttctaaagattatatcaagaggaataataataatacaaacaataacaaacaccataacaacaaagaaaagaagaagcaggaggaagaatggcagtcacaggctcctattttaggccaagcacactcctaagcatcaaagccaaaaaaaaggcagaaaaatgttaaggtgacaaaggcaagagcccacgctacacaaagcatttcttggctcgccaatttcaaagcaactcctgagatagagcctcacaatctggctttgctattgatttgaagttaatatcaaattaacagaataccaaaatatatagtcatatatagaagcattccaaagctaaataaaactgtgtttgatttcctactagttgggattgtccctatcatcttaatgcagataattgtgagtctagtttatatccatattttacttttccatctgcaatgatactaatttttttaatagcagagccatcccccatatgaaagtatttggaaaatatatagactttcaaaatgacaatatagacgagactaagaaattattttctgggtttttttttgttttttaaatagagtgaaaaacgaatctctcaaatacaaaatatttttaaacgtgagaaacttgcacgctactccctcaaagctgtctaattcaagcaaacactaaatgacactggcagagctgattgagcagctgctgggtgtcagtcactgtactaggggcttttaatacagtgttttatttaacagtttacaaaaaccataggaattgggtattattaattcctgccttacaaatgaaaacactggcgttaagacaggatgagtgagttagtcagggtcacacaaatacatcttaaaccagttctggctattctgcagcccaagcttccaaccaccggcattgtatttttcagaatattgtataatttcatagtaattaagcaaatgtttacacttataagaaaaaatcagtaagacaatattattttatgttatgactgtatctgccgatgttttagatatactagcagtttgtggatataaggaattaaagttatctgatgtaaaaattatttattttatatttgcattttctctatttatcaatacacaactaggtcatgaaaaagactatgtaaaaaatatatgaaagtgtcaaattattcagtttgttcatccttttattgtggcccctaggcaacgatggctttttaaatcattttgtataatttgatttgcaaattgctaagtatcctagtttgtcaacatactagtctgcttctctaatttcttttcaattttacgttcttgtaaatctctttacgcttattaaaagatactcaaaaatatcactatcttttaatgttaaaccaactttagtataaacatattttatatataatgagtattatatgaaaataagatgggaaacccacaaatactattaaaaaacagttgctacaactaacacaatatagttattataaatatccatgtataaaaataacattctaaaccttaaatattatgaaatattctagctaaagtataatttaaaataatatggctactctaaatggtccaataaattataccaaattaattttcattaaatcaattaatctaataaacatcacttttaaaaataagtattttcttgtttatatatggcataataatttgtaaatcactacaaacatattttgcatttggaaaaccagatcattagagggaaaaaaaagatcctgggcattttcaaaattcctgagtttgttttattaaataaataaaaggctcttgaacaggagcataacaggatcagattaatatttttgatagagacacctcaaacttcaagccagaaacaaattggaagtggacagtagaaaatctgtggtagtctgggctcaggtgggaacgaagagaaagagggctattcaacaggtagaattaatatgatatgattgtgcattttgcagagtgaggatggaagtgccaggatcaactcttgattgattaatatgcacaaacttattgataaactgaagctaagactttttgagtgaccagtgatatagagacaatgacagaataccagcaatatcttgagttttgaacatgagtgcaatattaaaatggaggagtcaaactaaactttggatatattagtgttgagttcagaggagagagctgagacagagatatgattagagacatcctcccatagttggtagttgaagcaatggctttggataaggtctttattaaggagaatctgccaagaaaacagaagtagcctaggacaagctttaggaactctctcacttacagacgaggtaagagacaagaagtcagtacaggaggttgaaatgtgattgtcagaaaagtagaaggaaaacctcgaatgatgtagtacattgtcagccaaagaaagataaattatcaagaagagagtggcaccttctcaaactttttaatactgccagtttatctactcatatgaatgggcagtaacattgtttttaatcctattatattactctttctgtagtttatcttcctaatgagattatagcattcctgaggacaaaagcaatatagtttaggtgcttaataaatataaacaggattgaaattgccaacactatttttatcctagaaaaaaagtgatacttaatattacatcttcacttcctttaggtcttggtgtcagttctcttatcagaaaggtctctgaccggcagtttaatatctttcctctctcctggctctgtatccgccttactcaatacatttttcttcataaaaattaatgcattcattcaagtgatcattcacctaacaaatacagagcggtctataagtctggaaaccaatatatattatgttttaaagaagatatttttatcactattttcagacttaataaataccttgtatcttgatcttctctctgatatcatatggattgttttagataagtaaggtggtgatttttaaggtttgtgaattttgtgtcaacaaatatttttaaaaagatacatagtgctgcaataaacgtacatgtgcatatgtctttatagtaggaacagaaacccaaacaccacacgttctcactcataagtgggagttgaacaatgagaacacatggacacagggaggggaacaccacgcaccggggcctgtcggggtggggagcaaggggaggggagagcattaagacaaatacctaatacatgtggggcttaaaacctagatgatggattgattggtgcagcaaaccaccatggcacatgtgtacctatatagcaaacctgcatgttctgcacatgtatcccagaacttaaagtaaaaaaataaaaatcgtttatgaatcattgattcataaaatgaatatactagaaaaagaaaataccatattcagaagtgcatacacacaaacacagcccccccaacacacacatatgtaactaaataaaccaatgcagataattataaattgtgacaaattctgtaagaagaaattagtagttgaagatctaaaatgaaaaaaatttatagaaaaattttaaattgactggtctgggagggcctcttggaaggtgacatttgaactgacctgaatcatatggataactcagccatgaaaagtacaagtgagaaaaataggaagaaagggtttggttttcctgagatgcatagagaagagtatggctgaaacatggtgaccaaggatagacatcttaagtattcactctgaaaactagcaaagtagccacacaataacatggcagaactattgctaaatatgatagatttccttgaagagtaaagtatatattacagaaaaagtgaaactcatgtataattttcttacacatatttaatggtttaattcatattgttttaatttgtaaatttcagaagagggatgctctaagtgggtgaatgtatcctacgatttttagggttagggatctctctatgcctaaatctgcctaaaagagatgtgaatttaccttgcagtgagagtcaggagtcagaatattcagagtctttgaaagccacagaagtcaccctggtttgatcatatagaatacatatatgaggatcaagtgtaaaatgctactgacaggtctagtaagagaaagactgaaaatgttctttagtggcctgaaaattatcagacactatgaagagcaatctcatcaataatccatagaggttgaatgcataacaaggtggaataaatgtaatccaaattagagctcttggatgacagaatttttagcgttaagtgccatttcagttggaacataacattttatacaaatagtttttattttgaaacaatttaaaacttaccaaaaaaattgcaagaaggataaaaaggccactactgtacccttcacccagagacctccttcaacgtttgttacttgtttgaaaatgtccttgtattagtctcttttcacactgctgataaagacatattcatgactgagcaatttacaaaagaaagaggtttaatggacttacagttccacatggctggggaagtctcacaatcatggtggaaggaaaggaggagcaagtcacatcttacatggatggtggcaggaaaagagagagaacttgtgcagggaaactcccatttttaaaaccatcagatctcatgagacttattcactatcatgagaacagcacaggaaagacccatgcccaagattcaattacctcccaccagattccttccctgactcgtgggaagtgtgggagttacaattcaaagtgagagttgggtggggacacagccaaaccatatcattccttgtctggccccttccaaatctcatgacatcacatttcaaaaccaatcatgccttcccaacagtcccccaaagtcttaactcatttcagcattaactcaaaagtccatagtccaacgtctcatctgagacaaggcaagtcctttctgctcatgagcctgtaaaatcaaaagcaagttagttacttcctagacacaatgggcgtacaggcattgggttactagagctgttccaaataagagaaattgtcaaaataaaggggctaaagtccccatgcaagtccaaaatccagcaaggcagtcaaatcttaaagctccaaaatgtgtcctttgacttcatgtctcatatccaggtcatgcagatgcaagaggtgggcccccatggccttgggcagctctgcccctgtggctttgcaaggtatagcccccttcctggctgctttcaagagctggtgttgagtctgtggcctttccaggcacacagtgcaagctgtaggtggatctaccattctggagtctggaggatggtggccctcctctcacagctccactaggcagtgccccagtagagactctgtgtggggcctctgaccccacatttcccttctgcactgccctagcagaggctcttcatgagggtcccatctctgcagcaaacatctgcctgggcatccatgcatttccatacatcctctgaaatccaggtggaggttcccaaacctcaattattgacttatgtgcacccacaggctcaataccacatggaagctgccaagacttggggcttctgttctctaaagcagcagtccaagctgtatcttgcccccttttagtcacagctgaagggactgggacacagggcaccaagtctctagactgcacatagcagagggaccctgagcccgacccatgaaatgattttttcctccctaaacctccaggcctgtgatgggaggggctgccgcaaagttctgacatgccctggagacattttccccattgtcttgatgattaacatttggatccttgttacttatgcaaatttctgtagcaggcttgagtatctcctaagaaaatgggattttcttttctatcacattgtcaggttgtaaattttccaaacttttatgctccgtttccctttaaaagctgaatgcctttaacagcacgcattcacccctcaaatgcttttctgcttagaaattgcttctgccagataccctaaatcacctatctgaagttcgaagtttcacaaatctctagggcaggggcaaaatgccacccgtctctgctaaaacataacaagagtcacctttgctccagttcccagcaagttcctcatctccatctgagaccacctcagcctggatttcattgtccatatcattatcaacattttggtcaaagccattcaacaagtctctaaggagttccgaactttcccacattttcctatcttcttctgagccctccaaactgttccaacctctgccgtcaccagttccaatgttgcttccacattttcaggattcttttcagcagcacctcactctactggtaccagtttactgtattagtctattttcatgctgctgataaaaacatactcgagactgggcaatttaccaaagaaagaggtttaatggacttacagttccatgtggctaggtaagtctcacaatcatggtggaaggcaaggaggagcaagtcacatcttatgtggatggtggcaggcaaagagagagaacttgtgcagggaaactcccatttttaaaaccatcagatctcgtgagacgtattcaccatcacgggaatagcacaggaaagacccacccccatgactcaattacctcccactcggtttgtcccatgacacatggaaattgtgggagttacaattcaagatgagagttggatgggcacacagccaaaccatatcagtcctttacagcaaaaggacccactctgggatcacatgtcacaccctgtttttctgattctccagtctctaacaatcataattatatcttcactttagtaatttcttcactttcacaaccttctcattcttgaatattctatcccagtcatttgtcgcttgtcctgaaattggattagtttgatgttatacccagccttgtatttttgacaggtgtcttacacaccatgctttattcttctcattgaatctcatcaggtggccccccagtatcaattggtcctgttactcatggtgataacattgatcacttgattataaaggtatctgcctggtttctccaatgtaaagtgactgctctcccctttgaaattaataaacatatatatttttaaaattggggtacttggtgtatatatttatgaggtacataagaggttttgatacaagcattcaataatggggattggggtatccatctcaaacatttatcctgtgagttacaaacaatccaattacattgtttgttattttaaaatatacgattattattgactgtatttaccctattgtgctatcatatagtaggtctcgttcattagatgggggtggtttatgagttttttaaaaaactatatttttaaggagatagtttgaggctatgttctgcttccaactttcacccacttatttgagcacctattgatatgccttgcctgaattaattattaacatgatggtttccaaatggtgactttcttcttcctacattcctgttacatgtattacttagtgtagtgctattggaggagctttctattttccctgtgtatttattcacttttagacaggcagactcttggattcctactttattcagtaggatatgatctgtagcttcctctttttttctcctcccttttttattttgatattcaaaatctctttttgatactcaaattatttattttgtatgcaaattgcccttaatttgaggagcagatgccatttcaggctggctcctgtgtcattctgacatgaccccatcattctttgggcacttcattactttttggtgtggcaaaatgttccagattcttactgtactttccctaacacagcttagaatcagtcatttctccaaggagtcttggttttgcccagcatagaaaccaggatctgggaaacagaactattcattgctttgagagtgaccctgtacgtaggctgtcttcagtggatgataggaaccatctgtatattgaccaaatatacaatttcattcatacttatttctgtatctatctacatatagtgaaaaccacaaatttacactaattgattaaatcctaatgcaaacccactgggttcattctgtctttttttttcttttcttttttgagatggagtctcgccctgtaacccaggctggagtgcaatggcgcaatcttggctcactgcaacctccacctcccaagttcaagcgtttctcctgcctcagtctcccaagtagctgggattacaggtgcacaccaccacacttggctaagtttttgtatctttagtagagatggagtttcaccatgttggcgaagctggtctcaaactcctaacttcgtgatctgcccacctcagcatcccaaagtgctgagattacaggcgtgaacattctttcttatgtttcatatgtgtaccctctttctttgacgttgggaatttgactctcactatcctccatgtatttacttatttgcccaatcaacctgtactgtaaccaatctcccagccacatggggtggagatcctgtgtggacatcctctgtgcacaggtcctggacaccactagactctcttcccctggactactctatcttcctgcctgctgggaccctagtttttatgaggctgttttcctgcccctgctcaatgggtttttgactaagttattcaggaaggttgagtaaacagtagagattagtagacattttgttattcaggaaggttgagtaaacagtagagactagtagatattttgtgcaatctgccaagatcaaattgaaaggaagacagtaggtggttttaaacatccttaaagcattccaccagcctcccttggacctcccaaccttcccaactttaaaaaaggcagagagaagctttatatgcacttggttttaaacatgtcaatttttcaaccttgttgtccaccgtttgctttttctgtcccatcagatgaacattataacttacaacaatttaggttgccattttaatgtcaaaacaaatatcagcaagtttttcactgatgtatttctgaattaaaattttaaaaccttgaaaatgcttgtgttttctttgtcagcaagaatagcaatatactgagtggacttcaaatcaagtatgaagtttttatatgcaagtcttgaaacagaaatttcagacatgccagtgaagtaatataattacaatgttcctggaaagaagaaaggtttccagtgcatggaaagtaagatgcaattgagactgacaagattacaattcactgtgggtgttttaacacattgtcagattgtagaaaccagttacaatgacccatgtatagacattgtattttttattccaaattcatagaaattcaaagatataacaaaaatacgcaaaaattttaactttatatttttactaacttgacaattcgttacattcactttatttccattttatagctattcatttctgaccctcaaaatgccagctgcaaatttatattaccaaaaaatcccactgttaatctaagtaggttaaatcctgagctttggagtagtcactgaaggtatcacaaacactaatacactagtatttttactgaaatttcatttgttcataaagagaacaaacacagaaaataaataataggttctcctctgtttctaagggagttaaaacagcaggaggttcagtatcagagatccaacatctttagctcattgttgactaagggaactgtcaatattccaccagttacataatgtttcacaggtgtgagtaatcttcaggttctaattattaaaactgatttgagattataatagcaggatgtgtttgttatactttgtattagttatatattgctgcatagtgcattgcctcaaaactcagtggctcaatgtagtaataatttattatctcttacttttctgtaagaggccagtaatttaggagcagcttggctgggcagttctgacttgatatttcttataaggctgcagatacatgtttcctagagccacaatcagctgatgacttgactaggattagaggctccatttcaagatagcagactcacatggctagcaagctgctgctggaacttggtaataggctttagttctcctcctaggtgcctctccatcttactacttgagggtttccatggcttttaggctggcttccctggagtaagggatcaaaagaccaaggtgcagcctctaatgcctttatacttaaccttggaaatcatatcaccttgttactactgcaacattctgtgtcacacggagcagcactgattgtgtgggagggaactatacaggccgtaaatattaggaggtatttaaaataacataattataatgtgaagatttatggccatcttggagattgattgccggtgttcaccctacagcccacagagatacatatctttttccacacacgaagtacacccaacctcctctaaaagccatccaaagtctcattccactaggccatctgctcaaattccaggacctcattgtctaagtcaagtcaatccaaaatgaatctcagagagtccaagagaaaatgaagctgtttaggtatagtcactcaagtaccacttcccaagtacagttgtcaatcttaagacctgtaaacaagttttgtgccatcctcacaccacatatacaatggtagattatgcacagagaaaccaaattagactctctggttcaaaagtggagaaaataagagagacaagtcactggtccacagcagttttgcaatccagtcaggcacatgctggtcattcttgattagaactcagtcatgctgtttcccggacatgattctccatggctcttggctctgccctctgtgttagttctgccactgtaagtcatcctttttttatgtatatagaggttgtctatgtttacagctgcatagactcctgaccataaagtttggaagtcaaaggcctgtttctattttgtcccaactctgtccctttcagtacaagctggtggtgttacctccaatatagttatcttaaaaatgaatgggttttctatgaattttattcaggtttactccacttaataaaaggcacatccacaattatataaagataagctcccccttaccccttgagcttctgtagatctacagaaggaaaatgcttttaagataattagaatccctattgtttaactgaaaagacctgtaaagcataaaaataagctctttagagggtcttctgtctcatggagtgtctccctgaggaatacctaataattttcttgggtctttatgtagattttatagtcacgcttccttgtcatccttagatcatgttttcctggaatttgatctttgcttagaaatgtgatttcttaatgtttgcattgttcaccatctggagagattggaattgaaagagcattttactttaaaattcagtaatgcctggcttcttcatttgtaatagttcttctttagctttttctctcccattttctttttcttttactataaacagaagatgcccgatggctccttcaatactctacctggaaatgtccttagctagattatacaatttcatttaactgtatctttttcttttccatattatcacaagaaacaatgttgctaaactttccaccagaacatagcaaagatctaattttctctaatttctgatgacacttttctcaccttcctttaagtcattacagctcctcaagagccatcacgcttcttttaaggcctgtcccgctaacttgcatattcctgtccctaaattactgccacattttcaggtttctgttataattctctgccagtatcaaattctttttttttttggtactaaagtattttattctattttattttatttttaatttttatttccataggtttttgggggaacaggtggtatttggctacatgagtaagttctttcgtggtgatttatgagattttggtgcacccatcaccttagcggtatacactgaacccaatttgtcttttatccttcacccctctcccacctttcttccctgagtccgcaaagtccattgtatcatttttatgcctttgcattctcatagcttaactcccacttatgagtgagaacatacgatgtttggttttctattcctgagttacttcacttaggataatagtctctagtcccatctggattgctgtgaatgccattaattcatttaattttatgactgagtagtattccattgtgtatatgtataaaaaagccacatattcatggcagcacaattcacaattgcaaaaatgtggaaccagctcaaatgctcatcaatcaacgagtggataaactatggtatatatacaatggaatactactcagccataaaaagtagtgaattaatggcatttacagcaacctggatggcatgtccagacatcacattctttatttgatatctattgttgcattatgtgtcaccttaaaattaatttcaaacaatgatgaatattcattacctctcctgggccactccagaagacagtgtatgacatggtgatgacttgccacgaagtaagtgatctcagagaccaagttgcagagttttctattgttcacagaagtcaggcctaattgattatagaaggggacaacaaaagggtgtgaagtcaggagccaaagattaacgatgtccatcttggaatattatggagagaaaaaaattaatgaatatgtagtattttgtcctataattatcttctcctagaatatatctcctattggaaaataaaaggacttaaccacttcaaacttcaaaattaccaagatcaaacagaacattgttataagcgaatgatgaattcttgttttacaaccttaattatacccaatttgtagtaatcggtatttatgcagctgctgtgcttcagagcagcttttattttcacacatacatccattcattttgaaatctttcaaagctagtgtggatatggtgagactcccaattattcaaaaaaaaaaaaaaaacagaaacaaatgacagtcttcttaagagtggtcagtaagttacaactgggtgttttctctctgctaagtttagacattacactctattcaattttatcttgattaaacaattgaaaatcatgtgtgcacgcaactggtataaacagatcatttacctaatatcagcatttttctgaagggactaagtcaatgcgaatgaaaaaaatgtggttgactagaaaatacacatacacacacacacgagccatatattaacattaaagtagagccttacatggattttttttaagtcaagaagttaattcaaatacaatcttatttttatacagtactgtgttaataggaaataatatatacctttgtgattaatccttataggagattcaaatgacagttattggactttaaatattgtaatccattaatgaagagaaaaagaagatttctgctctactaaaatactatccttggtcaaaaagaataggatattttgaaaatgtcacttaataactggtatggtttggctgtgtctccacccaaatctcatcttgaattgtagttcccataatccctgtatgtcatgggagagacccactgggaggtaattctatcatttcataatagtgagtgagttctcatgagatctgatggttttataagagtctttttccccactttgcctgacacttctccttgctgctgccctgtgaagaaggatgtgcttgctttcctttctaccctgattataagtttcctgagccctccccagatattctcaactgtgagtcaattaaacctcttttctttataaattacccagtcttggcatgtcttttttaacaacatgagaacagactaatataatggccattttttgtttttattgaaaattcacttttatccatttaatggaactttggttccatcccattttatataaattgtttgttgttacagatataatattagatgaagtgaatgtgtcaataacttcagatttgcaagcagacaaattagtacagtttaaatttgcccagtaggcagatttggtatggtgaaccatatgaaaagtagaagctctggggactttctggagatacttaatgggattgaaaaatatcattttcttatggcctacaaattttccatccataatgggtgtttctatccaattatgcatgtttctcttaaaaagatataatagtaattgattggtggtgatctcttaaagttatttagcaataaactcttaatgtctgatttcaaggttggtgtgggcattctatttcctaatagaatcaacagtattgtgtgtgtgtgtgtgtgtgtgtgtgtgtgtgtgtgtgtgtttactcttgttatttactcttttaattttagttctatctgttattatttactagtatatataccatattatggtattttatatataccatattatggtattttatttataccatattagatagtttgtagaagatgtatattcaaagtagggtggctgacccttatgcctaaatttatttgcttctaatgttcccttagattttataaattaaaaaaaggcatctataatgcaaatatctctttgtaatgagttacacactaatctactttatttcataatagtaagtttggcttatttgacatctgaataacaggcaatagggaattaagaaaatagaaataaatatcaaagaaacaagaagaagaaagttggatagttgggaaagttctaaagttttgtgtcctaatctctgagggctggctcagcagagaaagaataacagtgagtctttgacagcagagggacagaaagatgtgacagtgagaaagatgatgtcaaaagagaaaatttgagtgacagtagaccccagaggcaaacatttacctggtaacccattacaattcaaccctgacttcttcctctgtaataatctcactttctcaaaaaacttcctttttctacactgaatataacatcagcaaggattaaagaaacagtagttggatgtgatggctgtggccaggtagaatacccacaagaattttagtgaaggttatactgtacaccagatttacattcccatttcttctgtttcacaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacaggtaaatgatcttttcatcctacctcacgttgtccaaactttccaaacctgtgtttctgttgtgagaccagtgaaacatcccaaaagaaaattaaagttaaaaacaggtaaggtggaaattaccattcaaagtacgtattgtagtatacttgtgatattagcagtgattatgtttatgtttttatgtggatatatatatcatatatctatcatgtatatcatatatagcatatatatgctatatatgagatatatcctatatgtgctatatgagatatatcatatataacatatatacatatatatgtagcatatatatgtatatatagcatatatgagatatattgtatatatagcatatatatgataaatatatatgagatatatcatatatatatatagcatatatatatatatatgtgataaaacacactgtggtgttatatttgttcaacagtctccaatcagagaatctgagccttcaataagtagttttgcaagcaacagcagtgtggcagagaaactctgacagttgatttttagtttacagcagaaatgtgccttctctttctgtctcaatcatgacttggcctcagcatgtgccttccaaaacccgcttctgaaagaaaaggaatattacaaaagtgtcagtgtgcaagatgggtatttatgaagcagaatatttagagtaactggttcagcttacaaaatacacctattaaaatatgacaaaaatcaaatctttattggttttgcaaacctggggagaaatttttaataaaaactttaattgtattctcacacagtgggaagatgcaacttttctgtgaaatattatgattatactgcatacactaccttaatatacttctagatagggcctgtcattccactatgaacaagtttcattttgagatgctttgtctgtaaacaaattatatatgatttgaagttaacctagtgaatttatatgattttctaagatatattgaagtcttttgaggaagaactgtcttatcctaaaagctcattttattaattttgtgtttagggaagatgaaagttctttaaatttttttaaaattttgaactaagatattaatcctatctcagtctacccacaacaaaatgtagaccataagtctttaacaaatgtattttattcaagaggaaatactttaagaagtcactcaaaaatgaattttacaaacatataaaataatctattttgaagtaagtttgctttcataaaatctgaataagatggcgttcgtgtgaatggtaagttacagtttgtggtggctgtaagatagaacttctataaagccttcacatgtttataagaagactttatgacatagtatactgcttatttctattcatgtatgcaagtactgatcttagtagcctaaacagtttatatttaaatagaatagtgaacaattttaatggaaatatactcctaattattgagccattaataatgtatcagctattatttctgcctagagcaagtagcagcaataatcagaaaagctgagatgaatgttttaaagatcatttgttctgattttagataattatctacatattgttttgtacagaaaaaaatattttcttcataatagttatggagttttttagtatctactctttttttcaggtcagtaattgtgatgatacaataatttcattacctctttcagcttggtaaaagggctaggtaatatgttgctgtttctctctaaacatcgtgtttctaggcattatatataaattgtttgctactaaagaaagaggggtgatatgttgagatattaatgttttactctgatagagacaggagttaaattggtcccaaaagaatgaatgggattttggtaaattaataaaatggaaggtgatactcctggtggggagaccaacacaagggaaggtatagaaaagaaaatacaagtttcaatttttcacagatacagagatacacaaaatttttttttttttttgccaaaataggtcaggcccaatattcatcttgccaagtttcctgcagctaaaagaacaaagttcacacctttcttattctttaggatgacaaatgaaaagattagctgcagggaagtagccacctgtgacacatctccacgcattttctaaacccattatgggacctatttttagcttacactttttttttaaggcaacaacatctgtacattaaataccaatgtgtgaaacagcagattcctttagtcacctaaaatgttcccagttcaaaatcttaagcatgaagtgttgtactttcataggtatgagacaggactattttacttaaaccactgaagagtgtattgatgatatcacccttaatctgtgtctttccaggtaaaagtaccagtggttttagtctgtcctcatagagcagtgatgtatccagataatcctttaatgatacacccctagcacatctctgcttctttctcctcgctgagactttgcaactgccccgtatctacaactttcttttcagattacccaaattctcccaaaggaagcctacagtggcttttcttttctccttcccagttccagcttgatcgatttgagagttatttttgagagggagaaaaaaaaaagtataaatgagaacatagggtaaaaaaaataaaagagctacacaagcctgacttttatagaatgtttggagataatagtcacagctgcaatgatttgatgagtagaacttagggaaacaatttgtctgaaggtgtttttctgtgtgttgtattggaataccctacgatttgaactttttttttttttttttttgctttgtgtgtagatttgcatgtggcttattttgttcacgtgcttattttctgaacgcagctttgaatcaaggaaaaagcaagcttgccaagctacagaattatgcattcagtatttattttctgagtgcatactagatgtcatgctattctaggcacttggaataaatccttgaacaggacagataaagattattgaaaattctaagctgacatggtagagggaggggaggaaggagagatgacaaactctaattaaaaagtaaataatctagcaagtgagaaggaataaattttatgggtaaaaatactagaacaaaacaaggaagcctggcatgtcagtagatcaaggtgttgagttgtagtttaaataggttgaccaggataagcctccgttgaaaagataatattactgcaagacttgaaagaggtaactgaatgtactaatgcagggaaagaacatttgacccagagagcacaggcaacgaaagaggcacttgcatgatccaggatcagtatggaagccatggtggcaagtttcgggaggtcaagaatagttgaaggaatagacgccagaacaagccctccagacttgtaggttattgtcagggtgtggcttttactttgaatgaatacaggagccatttgcagcgttctaaatagagcaacatgatgtactcacgtcttaaaaggatgaatctgggctgtgggagcaagaaaggtagaagcaggaggctaactaaaattatgccattataatccaggtgagagacgcgtgtaccctagaccagggtgctagcacaagaagtagtgagatgtggccaattctgaatatattttggaggcagagtcagtagggtttctttacaaattagatgtggggtatgagagaaatggaggaaatagggataaatccaaatgatttgctaagaacagcaggaagaaaggagatgccatctcttcagactgggaagactagttgtagagaaaattagtcaaaggggctaaagaaaaagtcagaaattcaaggttggacatgaattgaaatgtctactggacgtctaagtagaaatgtcaggaagagagttggatatatgtatgtaacaagcctgtgtctgcaggtttacacaataaacctttgtgattgacagaatcccttttgtttaactcttgagggtctttggtgtctttagttacattttataagcaatcatagaactggaaggggaggtggtggataatgggcagaaattgctctctaacaatggaagctgctagcttgattcccttagtgataatctgctcttagagaggaggattgtcatcaaccttcagtttccaaaacattctctgagaaaggtaaaatacccagagataacatttttgtttcttcttgcattgttactctcttttactcatttctagaacccttgcattattgactgcttgtggcaaacatcttaagatgcctgactcaactcttattctcaatctttttctctccagcctctttccaggtgtgaaaacctgagagcccaaaccttcagaaacactcctttagccacagttaggtccactcacttcttccttcaagagagaatcacaaggagaaccatagggcatctcaaagttggggagagggggtgcttggggagggacggacattgagggagagtcagggagggtattaggggatggagtgagtcagtccttgttggtattggctagaattcctaaactcggagactcgctacaacagatctgatagttggcctcagaacttgtgaattgttgtagaattattgtttgacctgtttttctgtggttgtagccaggacacatggttaggaagaagctgatgttaacatattttgagcttaattaagtggtgatcatgcttggtttgacaatttttttttctgttttgtgagtaatagtgaagtccattttgcaactgtggtttctgtttcagtcctaagagcactcttcacagctcagctgccagaggaatgttttttactttatgctaggcagaagcagagatgagacacagttctggctgctaagagctaagcagaagttagctgtggtgttcttgggaaagcttttgttctcctgatacagttgcccctcttgctctccaccatccttggtaaaatgtagaactgatgtctagagctgtagggtcaagaaaaccatagatcgagcagccactgatactaacttgtatgtgaaaaatatcaactatcacttatctaagtaattatgaattaagttttatttttcttggagccaaaagcacctgccctttccctagtccccacttctaaaattaaccagtaccatcattttaccagaatacagaagaacaaattcctaaatatggaaatgactttgaaagaaaagataatactttttggagtgtattaagttgcattttagtgatgtcccctagaggttgaaatctggggactaaatagctgtttagaggccaaagcaaattcatattgttagagccagcactagtaaaaagtgactcattagaattagaatctcctctgctctttcctgtctaactccattgaaaatatattaaaaaatacatttagaaacaaaatcagtaaacatcccagataacacagagagcggaaaaggaaatgcaaattgcccaacttaaacatagcctacaaaattaccacttgagaaattatgaatagactagatcctattccagagttagtaattaagtcttcattatatttttggatgaagtacataatcacagacccagtttttttttaattcaatgctttattttcaagaatatccagtttgatttttttctttcaaagaaaagaataagtaaatgaattttcataagaacatttaaatgaggattaggtagatacatgaaaaatatctcaaaactaaattgactctgttggaaaggcgaatgaaagcagtcaagaaggatgatatggtttggctctgtatccccacccaaatctcaagttgatttgtaatcaccatgtatcagggaaggggactggtgggaggtgattggatcatgggggtggatttcccccttaccgttctcatgatagtgagtgagttctcatgagatctgatagtttaaaagtatggcactttccccttcactcactctctctcctgctgccatgtaagatgtgccttgcttcccctttgccttctgccatgattataagtttcctgaagcctctccagctgtgtgggactgtgagtcaattaaaactcttttctttataaattatccagtctcaagcagttcgttatagcaacgtgaaaatggactaaaacaaaagaggtcatgagtttctacaaaagcaggcttaaattttgcgttcataacttagatgaagaaaacatgtaacatttatcattttctaaaatttgtcttcattcgctaattccctatttctagtcagtagcagaaaagataaatacttgaacacatacattttggtactgtaatcactcctcctttccgtgtatattcggtcaacatgggagttgatctcagtcaaaggtaaacttccttttgtggttgtactaccatttcaagagttctagatgccctagcatggcttgggtcagagtcagcttatgcaatacgttatcaccacaggggtgggatctgtcccacctgctccaccaaggttccctctgagctccctgagagtccccagcctggtcggccttcagggtcccacttctgtccctgccacccactgtcatgacaactgctccttctggccttcagatatgtcatgggtattgctggacttaggttctgggatctgtgtttaaggtgacagctattcccagcatgtctgagtcccatttggttttagcattgagagtcctgcttctggagaaacccctcagttctgggtaaattaggatggttggtgactatacacactaggtcttctttctcctaataccttcgtctgatctaccagccatctaagcattttataggccctatagggacacacagtgatttctatatcttttggagactacataaagctgaaataaatcatggcatatgtgttgttggggagaggttaggcattagggacagcttccttaggctacgccccctttacttcagcatgccatccctccctatctgctctacacagccactcaggctgacatgaggccctctacacattagaccctcaaaggccatcataggattcctaagtctctgctgtataaaccaaatataaaattctaagccatcatactgactgatgaaccctccccttagccaaagacattccaaataatcctgaaaaaaaaaaaaaaaaaaactagtttaggtcagacatgcctcacaaacatcaacacagagaccttaagactgatagaatagtctctttaagtctgataagaaacatctacaatccattctctctgaagactgctacctggaggcttcatctggatgatcaaagttgggtccccatgactgcttatcctaacccagacattcctttctattaattccatgtctttaaataataactctttcaaccaattgccaatcggaaaatatttaaatctacctatcacctgggagcccctgctttgagttgtcccacctttccagatggaaccaacatacatcttacatatattgactgttgtctcatgtctccctaaaatgtataaaaccaagtcacaccccaaccaccttggccacatgtcctcagatcttcctgaggatgtgtcatgggaatgtccttaacctcagcaaaataaactaaattgattgagacttctctcagattcttttttggcttagggttgagatttattcagtcaacaaatacttcttgaagatcacaccaaccagcagacagtacctcctgggactgaatgctgaggtgacgaagggagggtgattgatcagactctacactgttttaatggttgtttggcttttatgtcttaacacttacaatgcctctgttttgctctcaaaaatatagctttttccaatcaaaagctacttggttttagactacttttccaaaattaaatccacatgtttcttaattttctgtttcagtccagactctagaggtgaattatcccagaacctactttatatgataattgtataaccattgatccactggtaagacagccatagagtaagaaaaaaaaaattttattagtgtttctttagtgatggtttttatgacagatttcctttctctttcacctgaatcttgctgactccaaactgctaccctctaggtcggacacctccttttttcatacatttccaggttgaccatctccttctctttttttctttagaaatgttaatgtcatcatttaagctggcgtcaaactgtgcaggcatttctcttactttgggaaatattttgtcttttaccattaggtgcttatttcattacgcatactgtaggcttctggaaataccttactttcattcatgataattattgataagaggtaaagggggcagaaagtctcccagataaattcacgttattcaaaactctacatttgctcaatcctgacatcgttgtgactgtgatcccatcaaactacaaataatcaaagaacaggttggctgaagctaattctgaaagaacttgagccaacaagcaatttttcataagtgaaactggatttccttttagagactgtgcttcggacaaaagctcttgcgtcctaaaacctaatccccaacttaaacatatagaaaaacgtcagttttctcatggggtcatcctattgtgattctttcaggtagatacgttcatcttgtcccttcaccttaactcggtttatttcccatattggattccactgatttttatgttgcaaatcgctatgctctatcttagtttctgataaatgaaactactggcaatttctgagaagtcccatttcatcatgctaaatctgacttattcataatattagatgtgtgactctttatttaaactttattggccttccatgctaactccagtctttcatttgatctttagcttcctttggtttcttttagaagggaggagcttcctgtttatacataaacatttaagccatgggcatctttctagcacaaaaacatcagctcaatgacctaaaagtatcacatacccaggcgaacccatgttcaagtcagttgcctctctgaagtgatttcaaagtgattttattttaagtacaaatagaatactagagtgacaaaaacatattcttttttaaaaaaaggtagtgaaatgccagaggagataactctcctaagaaataaaggaaaagaaaaaagttgaattagccattttaagattcaacagcagctgtattcttctttgatgcattgcatgtattaggacaaaagaaaactatatttgcttttggcatggcatatagctgtgctttgacatttaaatcccaaggaaggcttagtgcattaaagtaatgtcagaaaaacagttatatgtttgaagataagcagaaaggaaatagataaatagttttaacatgtagctaaatcaactacggagagatttaaataagccaatcgattttatttcttgcttttgatatcatattacctgcaaaataaaaataagagcaattgattttaaaacatttaaaatatctttcttaacaagtgctttcttcttaaaataattgtttttgtcaattacttgaatacattgcagttacgatttcacactaagaattcatttaactgctctcccctaaaccaagattacagactcatggacatgtaccattctttttgtaaaatattgggactgatacaacttaatgaaggggaagttggagcttgtaggacactatccttcatttgctatatgctccctaacatgctgtgtgggagtcagttgttcattcctgaaaatgcatatgcaagtcatacttgttactgtaataacatggtttaattaagtactaagtacattttcaaatgagcagagacagaaaaaagtttctggtaaaatcaaatgtaaaagttttagaaagacaagtggctcaaaacaaacacaaaaccataagtttatgtgtgggcctagacaactgtaaacatttgcagagattcataaagcccaaggtgaactcactgaaattcattggcgattttagttttcgctgcacttgaaaccaaaactgaaaaatgaaggtgatactatatggaaatggtttgataaaaaggccggtggattgaactacagacttcaaataagtcttcaaaaaagtctttgggtgaactcacacccaaaggccccagagtaattccctctaacaacgagtcattgaggtgacataatgtaggttttcagttaaattaaaatggttaaggtgtgtatctttttaatgacatttctttactggatttcattaaacccaacatattgaagacttgtatcattccccaatctgaataaaaggagagttcattatttctttttgctttctctttttgaggagtctttgcattccaaatacagagaaaaaagaaaaggaaaggagaggagaggaggggaggaaggacaatctgttacatcacattgttatctggtttattagtataagactcttttactttcattaaatgtcaggagtaaaaatttacaatggtatttattatagcatttgaaaataacattttgtttgaatttttttctttggtatttaaatgatctataagctgaaaagaagaggagtcatagatttttctatgccaagaaaaaaacagttttaaaaagatgaagttgtcattttcattttgtttgattaaaaacacatatttccatttcctctttgtattgttgtatctatactgcccaaaaactagttttaagagggcaacaagcttagtttttcagatagcattgtctaaaattctcatggcacccattgctatattagagataagtactttgttgtctttgcctatgaattcattgaggaatattagagtctgaatcttgttttgtttaccaaatcctgcttacatcaaaaagaatgttacatgagtaagaaaggaatgcagatggaaggggtgaggagtatgtgtgtgtttatttgaaatggttttgaaaaatgagtctgtaataaattttaacaaattacggtatctgaaaagggtgtcttaatcagtaaacaggttgatttaaatagaccattatctacaattgtgatcagggtaaaaccactaagtaccatacaacatttgtgtatagcattaactttgtttgccttcaacgagtcgcagctgttatacttttactgtgatagtttcatgatttttgcttctttggcatagtcccagacaggcttcatcaacaagaaacttatcttcatgaacacacttcagtgaagacccccccctctgggaaattagacatgacataaaagtgcattgcttttttaaaacacttcaggcatttgaaaattacaagagaaattttcaagtggcacttcctaagttagaaataccatacacataaggccgggtgcagtggctcacgcctgtgatcccagcactttgggaggccgaggcgggcagatcacgaggtcaggagatcgagaccatcctggctaacatggtgaaaccccgtctctcctaaaaatacaaaaaattagccgggcgtggtggcgggcgcctgtagtcccagctactcgggaggctgaggcagaagaatggcgtgaacccgggaggtggaggttgcagtgagccgagatcatgccactgcactccagcctgggcaacagagcgagactccctctcaaaaaaaaaaaaaaaaaaaaaaaaaaaaaaaaaaaaagaaataccatacacatgaaggcaagtttctctcacatagttattataggacacttgttaatctcctatgaaggtcaaggccactggtactaaactacacaatgagaaaaccaaaagttacaggataggatctcttctcccagaacaggtactgatgtagcctagagacagtaaacattcacaagaaatgttaaaactatgttaagaagcatgtaagcatttgcttcttaattgttacagataatgatttctatagaaaattaataagaggaataaaaccactatcagctgcgtggttaatgaaaaccgcataaaagaagtaggttgaacttcagaggagcattagcctcggatgatgagaaagaaaggcaggaacatgccaggcaaaatcagaggcatgagcagaagtgtggaggcacagataaccatgtcccatttctgaaacagtcaagagatcatttaaactacagcaacatgtttgtataggagagtcatggaaaagttgaaaagatctatttttcatttattcatttatccattcattctacaatgtttcattgattgcataccatgtgtccaaggacagttttagccttgaagaataatttgtaaacttatggattctactttcttactgatttatgaaagagttagacatcagaaaaagcacacacacacacataccccatggaattgttggaaaaaaacacacaaacgccaaaatcaaagtatgcacaagggatcttgtgcctaattctccctgggatctaggttgggatggagatggcagaggagcagttcaaggcacatgctataggcattccagggagctggaaagtacatgggtgtgaatgacttgagtacgtgcagtaaactcaaggatttacagtaggttctttcacagactggcagctactagtgagggaagatttgaagctaggaatttagggggatcctaatgaaagaggaccttgcggccgggtgtggtggctcacgcctctaatcccggcactttgggaggctgacgcgggcggatcacgaggtcaggagatcgagaccatcctggctaacacggtgaaaccctgtctctaaaaaatataaaaaattagccaggcgtggtggcgggcgcctgtagtcccagctactcgggaggctgaggcaggagaatggtgtgaacccgggaggcggagcttgcagtgagcgaagattgtgccactgcactccagcctgggcgacagagcgagactccatctcaataataataaaaaaaagaggacgttgcattactagaaagactgtaatttatcctttgagcaatacgcagccattgagggattttcaggaaaatcaagttttgcatgactaacacttgttctgattacctgggcagaggtgatgagaaatgaattactgcagtagaaccaggtgaaaaaggaaatatccaaggtatttaggagttggactgaggagagagggctcattagatgtggaaaccggaaaaggtattggctagaaagagaaactggtttcagagtaagaaaaggctttaatgaaagattgttatattcactagtctccccaaacaatgtcttaactgactatttgtttagtagtgggtctaccggttagggtaagattttactgggatctggaagatggtgaaaaccagtagcagcaattgagcaatagagagtggtaaaagagaaaattaaaatagaggcagaattgagatagaagtgcaggtacacttagaacgatctgatctttgacaaagctgacaaatataagcaatggaaaaaggaatccctattcaataaatggtgctgggataactggctagccatatgcagaaaattaaaactggaccccttccttacacaatatacaaaaattaactcaagatagattaaagaattaaatgtaaaacccaaaactataaacactttgcaatacaacatatgcagtaccattcaggacataggcatgggcaaaggtttcatgacgaagacacaaaagcaattgcaacacaagcaaaatttgacaaacatgatgaaattaaactaaggatcctctgcacagcaaaagaaactatcatcagagtgaacagacaagctacagaatgggagaaaatttttgcaaactatgcatctgacaaaagtctaatatccagcatctaataggaactgaaacaaatttacaagaagaaacacaatcccactaaaaagtgggcaaaggacgtgaacagacacttttcacaagaagacatacttgagatgaaccatcatgaaaaaaaaaaaaacctcaacatcactgatcattagagaaatgcaaatcaaaaccacaataagataccatctcaggctagtcaaaatggctattattaaaacgtcagaaaataacaaatactggcaatgctttgggaaaaaaaggaatgcttatacactaccggtggaaatgtaaattagttcaaccattgtggaatacaatgtggtaattcctcaaagatctaaagacagaaataccgtttgattcagccatcccattactgggtatgtaaccaaagaatataaatcattctattagaaagacaatccatgcagacattcattgcagccctattcacaatagcaaagacatggaatcaacctaaatgcccatcagtgataaaatgtggtacatatacaccatggaatactatgcagccataacaaataataagattatatctcttgtgggaacatgaatggagctggaggccattatccttagcaaactaacacaggaacagaaaaccaaatgtcacatgttctcacttataagtgggagctaactaatgagaacacatggacacatagaggggaaaaccacacactggggcctgtcagagagtgaaggatgggaggagggagaggatcaggaaaaataactaatgggtactaggctcattacctaggtgatgaaataatctgtacaacaaacacccatgacactagtttacctgtgtaacaaacctgcacatgagcacctgaacttaaagttaaaacaaaacaaaaacaaccacaaagaaatgcaggtagtgagatactggattaaaaaggaaagcagaagatgtgcagagctatactctctaatactgcagccactagccatatgtggctatttcacacttaaaaagcagctgttctaactgagacgtgatgttagtgtaaaatgcacaacagattgtgaatacttcatacacacacaggaatataagacagctcattgatcatttttgtattcattttattttgtgttaaataaaatattaatattattgtcacctccataagattttaagctacatatggcatgtggctcacaagttattaatattagtgctgttctggaatctttctctaggtagttccagctggatgctgtattgcaagaatgagtgccctagcttctttgttggtcttgtccacagatgagtaaagagatcctcgcaacttctgataggactcaacaagttgtcctttataactgttttatctcagagacaatgcagatccccagaatgtctgtgaaactggcatcattctgaaatcacagtcccttttcattagttagaagttttcttaagcctaagtgtatttgcaataccatctccagagaatatctttacagacttagaagccagatgtgttggttttctcccagaatattaattccctgttcattaaaaataaaataagaagtattcaatgggaaaaaaaatgtggcctaaattaagatggtattttaattgagcacaagttagaactttcctggctcaaagattaattttttctagtaaagtatctgtcagttacacaactgtgtataattcatcatccttgaagtgaaagtttgggtctcagtaagaaagtgctttcagctgttaggaacagagacccaatcagttttccaggcaaatctgaagtttatttctgcacatgtaagatgtctgaaatagacaattcaggctttgtataatatatctagaaagcgatccgagacccagactcaaacattctgctccagtttccttagctcatggtttctattttcccagtgattaagattgctgctagaactccagaaatttcatctgattttcataaagaaagtaggagggtccaccttccgttttaaaaagccattccagaagttccgtgcaacattttcaatcatatctcattagccagatttaatcacaaccacagagttgcaagatagactgagaattacagtttcattctaggtggtaatatgcctgctaaaactttgaggattatcactaggaaggaagaggaaaatctgtaatgagatagatagcactctctgcccagttgatgtttcgaaagattataaaatataaatagtaaaaaagtgcatgcttccagaaaaaaatatttgatgcagcatttatcttattcaaaccatatattttatatttttcctccaaaaatttaaaatatagttatcaaacttcaggcttagacaatcgacattttagggtattcaagagtgaagatgatccagcctcccttcaaggatttcataagagagtggcagaggtatctagttcttattctgacctcctactcgaaattcatcagtaacttcttattgcccttaagaaaaagacccagatccttaaaagcagtgtattagcctcttgtggtctggcctttgtcttcctttgcagcttcatctcacatcactctcctccatcccctctagccacgctggcctgtgctcagtgcctcagatgttctttcagtggggcccctgcctgtactgatctctgggtctagaattgcttcaccccaccacccatctctgtctctgtctcttgctttcttatccttcatatctcaattcatagataaactccattaggggagccatctcaggatctgtaagactgggttaggcactttttaacctgtttataatcacacattcaagactgtaattacatcttttcttcttctagactttgagcttcccaagaatgggaaacaggcctgagctcatgccccactgtgtctctgtgcctaacacagtgcttgatacgcaatatgttctaaatacattttttatagaatgaatggaaaaatataatagtagcataaaaaaggactatgaaattataaagaaggaaaagaacaattctaaatggagggatttagcaatgctttatgagtgaaatagaattaaaactggtccttccaggacagaaaggctcatatcagataatatagggcaaggctgtcttggaaaaatggactatataaactaaggcatgtgacacagctgaaataagaagttgcccaaaattctcagaatgcctgagaaaacattctaagaatttatgctttagtctgtagtccaaggaattcataaacttttggaatgtgcatacatgtttgtggttaagtgtacacattccagagacactgtcatcacattttgcctgttagaatggaaactcgtgtcaactcattcattcttaaaactctcctaccagtgtcttcccacctatcctcttcgagtcaatggtcagaaaattctagaagtgcatacatcggaaaagagtttactggaaatagttttaaaataatggcttagagtcaaggaatgctctacacccttctactttgccagtgaattgagtaagaaaacagctggtttctatcgaaaaatttactgtagagtgttttcttcatggagaaactagattttggatgtcacgagggaatggaagcgttggagaaaagtattcaaggtaaaacagtagcttgttccaacacaacaggctttcccctaagacaacactctctaaagaagtcctggaaaggaaaatgagaatgtggtagggcggttgatacagatcagtaaggaaatgaaagtccaaaagttatttacatggtaaacatctgtgccaagaggagtactctcaataacagggattagtgagagagcagttggctggagatggaagctcaggcaggtgagcgtggggtgcagagaaaaaaaaatgtatgaagaataaatcaatatttttttgagaatgagtattttagttcagtacttctcaatattttaggtgcatacagatcatctgggatcttgtcaaaacaggtttggctcagtgtgattgaagagaacactgggattctgcttttctaacaagcttcaaaatgctgttgctgcagctgcttgtgggccacatcttgaacacagcagagctccagcctctgcatctgggcccccagatacatgaaaaatgcagctcaggtagtgacaaaaaagatcagtgatgtgggcctttggtgtgttatggtttataaaacagaaaagcctattttcttttcccttaccatttccagggaaaataaagtaatggggatgatgtagaaatcacctgaaatagtctggcacagtgcttgcaaggctgtaggaaccaactgaagtttgctcaaagctttatgtacttctgtttctcacttgtatcacctgttatctttggagtgtcatgttttacgttacatattagcaatggaaacagaaaatggtttttcaatcactcactgtgtctatgcatagaaaggctgggcgcagtggctcacacctgtaatcccagcactttgggaggccaaggcaggccgatcgcttgcgatcaggagttcgagaccagcttggccaacatgctgaaacccgtgtctgctaaaaatataaagattagctgggctctgtggcaggtgactgtgatcccagctactcaggaggctgaggcaggagaattgcttgtacctgggaggcaggggctgcaatgagctgagactgtggtattgcactccagtctgggcaacagagcaagagtctgtctcaaaaacattaaaaaaaaaaaaaaaaaaaggatgccaacaatataatataacaaaatatctaaatgtgtagttgtttgatacttattgactgacttattttttgattcactatcagcagctttttcttaatttggctctttcattgcaaggaactgtaagtcagagttcttagttatgaataaacaaactaaaaagacagatgcaataaaattcaaatgaatttaagaaatggattctcccaggtgcggtggctcacgcctgtaatcccagcactttgggaggccaaggtgggcggatcacgaggtcaggagatcgagactatcctggctaacaaggtgaaaccccgtctctactaaaaatacaaaaaattagctgggcgaggtggtgggcgcctgtagtcccagctacgcgggaggctgaggcaggagaatggcgtgaaccttggggggtggagcctgcagtgagccgagatcgcgccactgcactccagcctgggtgaaagagagagactccttctcaaaaaaaaaaaaaaaaaaaaaagaaaagaaaaaaaagaaatggattctctatctgagaactgatagaaaacagaacccaaagagggcaagacaaagtcaaggctctatcacctgtcaccagaacacaatgttctagactcccctcagccatacagaataatccctaaagccctacacctttgtatacctccctcaaaatgtggtttcaggtgggagcatacaattgcttatgctgacacctctttcagagctctcacccttattctcccaccttggtctgtcttattaaagggtgctgccctgccttccacttaatttgaaatttctttctaatagacatgtcttctacagagatcagttcaagctagtccaattgataaggttaggctttgtgtccctacccaaatctcatcttgaattgtcatccccataatccccacgtgtcaagggagagaccaggtggaggtaattgaatcatgggcatggtttcccccatgctgttcttgatagtgagctctcacgagatctgatgactttttaagcggctcttcttctttcactcatcacttctccttcctgccgccttctgaagaaagtgccttgcttccccttcaccttcggccatgattgtgtttcctgaggtctccctagccatgctgaactgtgagtcaattacacctctttcctttataaattacccagtctcaggtagttttttatagcagtaaaaaaatggaccaatacaccaagtaagaacaacttgtaaagctacacatggaatgattaggaaaaaaaatgtgaaaattcataacaagggagcataaccattgaatgaccatatcatttgccgttaaaccgggccttttttaatcatggaaggagtgtaacaagtgtgaactgattctacaccggacaggccaaggtgcatggtcaccttacctaataagtgtgagccctcctgtggcttatactagagaaacttcttgattcaatagagctttaaaggtatgcattcatggatctccacccaaacgccctgcattaaaatatctgagctgtattgcacttatctgtttcctttaatcccaaaccaactgaatttctctgcttatagtttttgcagtcttataaattctgtgatgggcatatgttgcttactttctcagcaatgacttcctgtgggtgattcacaccctatttctttccatcagcctctgttttctgtttgggttcagagaagttgatttgtcttcaattacaatcagtttctcaacctgtggccacagggactatttcaagaacattcccatgattaaggccacacagcctgaaactcatgcgtgatcatgagcagcttggccttggactgaagacaaagtggagaacacaatcagaaagagaaataaaccacaatcttggtggctgtcaagccactggatcaagtctacacccaactccacattgagccaataaagttcctttttttgtgagtgcagacttagttgggtttttggtttacagccgaaaccatcagaaccaatacaactccagtgttcacagtgccccatattttgtcctgagatccctccacagtcccctttgtttcagaatggccaactgttttcatatcttatttcaaatttaagaaaggaaattcgttggctcgatttatcttttatctccagaatctagtaatatgttgctcatcaacatatggttcggctgctaggtcaagtgcccagccataaaccagcctctggggctggatgggagggctgctgttcttctctgaagacctgtatccattttcctgccttgcagataccagtaggaccagtattaggacatctgcataagatttaattttagaggccgtgtgcagtggctcagtaatcctagcactttgggaggccaaggcaggcagatcacctgagttcaggagtttgagaccagactggccaacatggtgaaaccccatctctactaaaaatacaaaaattagcctggcatagtggtgtgcacctataatcccagctactcaggaggctgaggcagcagaattgcttgaacccaagaggcagaggttgcagtgagccgagattgcgccactgcactccagcctaagcgacagagcaagactctggtctcaaaaaaaaaaaaaaaaagattcaattttatgctgcatattcattatcatctttgccttttgactgtatcatctcaaccacggttatgtatcacagaggcttagaatattataactcattgttttagtttatccaggctgctataacagaataccatagactagctcataaacgatagaaatttatttctcgcagttgtggaggctgggaagcctgagttgaaagcgctggcagatctggcatctggtgaaggcttgcttcccaggtcatggatggccatcttcttgcagtgttctcacatgctaggcaggcaaaggagctctctggaatttctttttttaaataacagcattaatcctattcgtgaaagtggggccctcctaaaagccccatctcctaataccatcacactggggattgggtttcaatatatgaattttggcggggacataaacattcagtctctaacattcaccttttgcacattagagaacgtctacaaagaaaacgttaaattttagttttggaaaacttcctttccttttctcatttttattctttcctttagcaatgtaattattattgtatggaacccgtatctgatgatggtgagtttaaatggatcaaaattattgttccttaaaagcaacaccaaaattttataagatatgctgcatactaattaaagctcaaggagccccaggcaagaaagaaagataagccattgcttaagttatgcaaaagtgtattaaatatttgagattaattaaaatctagagaaagttttttaagagttccatttaaagtttgcataaaagttcacgcaattattataaaacatttgctatcaaactggtttgatgaataagggaagtcaattagtaacatagtgaaataagagttaattcatgtttctctaggtaatttctttcctttgttctgtaaaagtcatttataactacataatagtacaatcatacaataacaattatatgccaatacccactgttttacaaagcgatggaaagcatagttctatggtacttacttattttctaagtgaataatattcttcttaaacccatcctgaaaatttctacaataaaagattcattgatggaaagtcaaaaagtttgatttctggtggtttttgttgttcataaaggaaatgaaagcacagcttttactgagcaggtggttcctggtgtgtgagcccttaatggaagaatgatctgtgtcaacaggactgggaaagttctgattctgacttctgaaattgacctttattctccatttcagaacacataagccacggtatcccttttattatatagacatcgatatgaagagaacaaataaagtcacaccaagaatgtctgggcttgttcatcttacacaatttattatttttgaggctatcacttagtggggaaaaattttcctgcaccctaatgtaaaattgcaaatgtgtttccccagagtaatgatagtctaaaaatgagggacagtgagtcgtaattaggattaggcttgggaaacaagttcacttatattatagcatgttgctatggcaaaaggaaaaatatggtctgattttcaaacaattgactggcaaatgggcttatcccatgccatctattaataatcaatacagcttattcaaaggacaaaagtcactttctctataaaagaaagtgggacaaatttaacaacggtctactttactgcaagttaggatagaatctagaggtaagtaaaaagctttaggtaatgtcttcaagcctcgaagcaccagctttattctcaccggggaacaaagtctaaagaaactttcatgaccactgtgtctgataaagaatgaaaattctgctgaactcagtggtgaacgtactcattattaaacggactcagaaatactgtggttcaaagcatgcttcctaaaaataaaaccaatataatctatgaagaaagatttccaatgccaaaaaaatttcaatgagcattcaaaggttgaatccatagccaccacatgaaatatgatataagcaagtcagtaagagccactgaagtgtacggtttcagagtgaatgtttgtttcccagggaggagaatccaggccttcctctcttctctctatgccctgcctgccctgctgtcttccagcctgcaggcaagttccctgttgctttcaagctggagcttggcaccacaggagtccctgcttgccctctcattcccaccaccaaagcctcctggcagcatttttagctgtgtgggccttatattcaacaacaaagatgaagatatatggctaggagtataggagaaattatgttcttgatatttatttggaatattaaaaagaacaaaaaaatgagctctatgttctacatcacatcatactgtctagcaagatgccttatttttatttaataatttcatttataaattgcctctttacaattatgattgaagactgagaccaagggaaaaagaaggcagaagttacaatatttcctgtgcctgagcttaaattttggcttccagtttcttggaagctttcttacagggttagcatacatctcagctggagtttcccatttagattatctaccagtgtttttgtaggtgttggcttagtatattaccaacattactgcatcaaatttgaaaataattcttcttgatctggtcccagatttgatccaagaagcacatgagtctgcaggatgtattcagactcaaagttctagaatagttatagattgtgatctctccaaaactctctaatctgggtgtcattaggtatttcttgagtctttgctatgccacttgctgtgctgggtggatcactagcagcagtcaaatttccttcccgacccagacatcttatcaaataaagcttagaggcagagattccactagacacacagggccacgagttaatctttgtgaataatttcattgttaactattgggacaaggtacaaaaaacaaaaacagaaacttgctaatggaatacactttctaagattataaattgcaccatttgccaaatgtatactgttagaaatgagagcaataatttgcacttactgtaagtccagcatacggagagggtcatatgttgaaatgccatctctattgaggtgtcataaaaaatatttcctccagcagcacccagtcattctaaggtattaggtataatttttaaagtattatttggtgttctgaataccaaaaaagtacatcttgagtaccacaattggtgacattaaagttaattattttcattaaatattgcagtgctgtcatgaggaatgaaacagaagagcaaaatgaggttagagatgggatgtgttcaacattgctccccaagtatttccaaataattaatgtattcattgaatgatatttattgagggtcagaaaaagtgccatggtatttgatacagcaaaagatcacatttatgatttcattctgtcactttctgcaacaggtagcatccccttgccagcaccaaggcagggttgcatatttgaaagttactccctcaaaaaattcatttaaataaatagatttttttaaagaaattatgaaatactaacgttgcattcagttagtgattttatatggtgtaggattgacattaaaaaatacttgtcattaattttactctgtattaatgttatattaataatttctgaaagtaaccaaccattctaactgcagaacccagctgtggacatgagtttctaggggaggactctgaaattgtgtcaatgtttgtaatctagtcctcggagaatacaaaatttttgacaaagaaggaggttaaggagtgttttctttttgatgttcacctccaaaggaggatcataaagaagtaattcttgaaaagtattgcaatgcagtcttcacaaaaaaagcttatccctgaagtacagaaacacacttaaaaggaacatagatgaaatctctattcaaagagtttgggtttgacctttatgcattacatattatcactgttttgaattaagctattactgtctcattgttattttagcagctaacaaatgagtaggtgttctgaaaagcagtgtttagcatcatgtaaaatgttattttaaaagttcatttccactgagaggattttctaataaccacgtttctgctagtaactcagccatatatatataaaaatattgaaattagagaaatagaaactactgctgtgatataatttgatagaaaaatattaatagatggtagacattgtagagtttctttccatgtagaaatgttacattggaggattaacagcacttttattcattcaaaatagtcacagcatccattctattttaaaatgttaaaatacaaatacaattaactaatgtatttatccacattatctaaattacacaaataaaatatatatttaatattattaaaatatctagggatctgatatgtcctggtatgtctatctaatctgtgtgtgtgtgtgtgtgtgtgtgtgtgtatgctgagatatatatacataaagatatatacatctatagatattgatatagtttggatatttttccccacccaaatctcatgttaaaatgttatcaatggggcctggtaggaggtgtttgggtcacgggggtggatcccttgtcaatggctagggccattcccttggtaatgaatgagctctcactctgtgttcacttgagacctggtcatttagaggtgtgtggcactgccccctcaactctctctcctgctcccattcttgccctgtgagatgcttgctccctcttggcctttttccataagtaaagctccttgaaacctccccagaagttgagcagatgccgtcaacatgtttcttgtacagcctatagaccgtgagccaattaaatctcttttctgaataaattaccaagtcttaggcatttctttatagcaattcgagaatggcctaatagtgtgtgtgtgtgtaactacagtatatatacagtatatatatatatagtatgtatatatacagtatatatatatagtatgtatatatacagtatatatatagtatgtatatatacactatatagtatgtatatatacacaatatatatactgtatatatagtgtgtatatagtatactcatacacacaatatatactgtatatatacacacacactgagcatatattcatccacacatccagtcctctcagccatggctctaccctgaatttatacactatgtatgtgtatatatacggtatatacattgtgtatgtatatatacatactatatatgtaatctgatatatgtgtaactactgattatataattcataatatttaaattcccttatgcaattttttactctgctattatcctaaatttataatcattccataatgaagcaaataagcctatgcctcattcctggggtgtttagaccctgtttagatcctgacagatgcaatgtcttcaattaagttcttttacacactgaagggatagttcaggaggatcattaatactgataccatctaagcagaaaatagtcacagataattaactaaacttaatcgtactttagtatggataccttctttacatcgaggatcaattttaagttcactgaaatggatgtggtaaacatatcagagttacctcctgtggcattatatttgtagtaaatgtagtttttcaaaaccctttaaatacttgaacatatttttaagctcacaaaatactttgttattattgctttggagccaaattttccaattgcaaatatctaatgataattttttatatataactttactgcatacaagttggcaaaagaaaaaaacaacaacaaaattttaacttctttgtaagaaatcaattgtagataatgaatgatcgagctacttttctgaccagtcaagaagtgtgaacagatgctggaactgaatagcagttgctaagactttgcaggccgaccaccaccaggctctaagtgtcctatacaacaggtggagatataaggacttcttttaattgcaagacacatgatgaaaaataaaaggcacattctgtccacccttaaagttctttccctaattccctaaattaggttcttgtgaaatacctgtagttgttatgaaagtcatagaatttaatttataggtgtctcttaattaagttaggttagctagctgatgtttgtttcaaggatcatggaatcggccatgcagtaatttatatgcccaaagaaaaacctgattaaaatgcttaatatgatgaacagaccttgaataatcttcataattatagagtacacactacttacatttttgaagtggttccaaaaccatttgtccactgtgtgtatcttcaaggaataaacaattcactaaacctcctctctatggaaatgtatagacccttggcccatcacctcctcatccttgcagattttaatgcctggttcactgctccatgatccaataaccctcttgtagtattctttggagttttcaatatccatgtagaccattctttcaatgaacctatctctgaaatattggccctcctccattgataccatcctccagcatgtcttaatcactcagttccaagatcatctcctggaactcaacataatcattaactacaactactccataattgtgcttctcatttcctgcagctctctaaattcactgttaacaaaagttacatctatgtcttgttcactcatgtgctcacttcccttccacttagctttagtcccacattctatcattatgactcccttgcaatcacctttgatttctttgctcctctctctttcctaacacttgctcagaaaaacagcaatgctgattaagtgaaacttgtgcttcagcatctccctggggggaagaatggaagaatgtggctggggaaaaccacacacctatgctgattggtctcactttaaattcatagctcctaaccttcagtgggaccctggtgttgcaatcctacttcattccgctgctccatttcctcctctcccccaataccttcaatctacccatttcttcttcagccaattacatttcctagttgtttaaaatacctacttattttcttgttctcttttaaagtaacaatcatcattgctttcactttcttttgcctcattctttttgaacctatttcaaaaagactttcatccccaccatatcagtccctgtcaagtcatcagcaatctgcatgctgctaaatctagtggaaaattcccaatccttaccttcagcagcatttgatacaaatcattccgtctttcttgaaacattttcttgtagttttcttagtatttctctctctctcttgcttctcctcctactaaacctactgttccttctcatttagatgtctcctcgattttctcatttccaaacagtggagagccccaggtttcagtccttggacttatactgcttcctgtctacacctactccctaggagatctcattcaagttccatattccatctgtatgttgacttatctctctagctatatcctctattgagttttagaccttacacacaactgcctgctcccagtcagcacagtctaacaaacatctcaaactctttgtttctaataccaaactaccattaaaaataaatgtttctctctcagttttctccatgcaagtaaatgtcaactccattcatctattcactcaaaccaaaaaccttagcttcatctttcactcttccttttgaccttcacatccagtccaacctatcaggaatggctctaccctcaatttatacccagaatccagtcatttatcttcatctccattgtatccacttctaggccacctgttggatggactgctgcaataaccttccagttgatcttcctgctttcacccatgccctgtccccatggtctaattttagcacagcagccagagtgatacatttcaatgagatgttttcatccccatcccattcaatgtaaaagccaaaggttttgcaagtggaattttttttttttttagaaattgttttcgttttcagatgatgagaataatgcatgttcaatagaagtgtttctaaacgacaaaaaaaaaaaattgttattctccttcttgttccacacaatgaccattgcctttaaaaaaaaaaaaatcactgttcaggattggaattagctaggtaggtatgaaaaatagagaggatttaagttgtatttgcaatattaccatggtgctttacttacagcctctctcattgtggtaaagaaagactgctccttcatgttacagctggtttatatgtaattattttttttaaatcctgtaagaaaactcactcaactctcctgaaaaaccccaaagtgcagagacaaaatattccataaatatctttagaaactccctgatctagcatccagcccaacctcacaatcatctatttgctctccaccccattgtcaaaccaagccatgtggaatttaatatggctacctaacttctggatctttctctgataacaattctcatttttgtatctgttgataaagaatgcttctactgaatccttcgtccatatacccaaggaagggtaaatggaaaatatcgaagagatgaatttttttgaacttcttgtcagcattgttaattgaagatgtattttcctattgatttgatcatgtgttacttgattttgttctgattctcagtttaacacggtatttccatctgaagcttctgatgcatacttcatttattctaacgttaaacagaattttaaagctcaaaaacttcaatgttaattgactgaaaatgctaatctataaattcattttattgtagaaatcttataaggatatgttgtatagttctatgtcatttcccatgaatttaagatttagagattaaaaaatcagtaatttgtaaatggtaattttatcttgagcagaattctatgcctgtaaaccaagattctgtatcagtcagtaatagggctgaatatgtgacgatgtgtacacagggagggtgtactttacctttaagctggccaaatgtgcttttttatttttttaaataaaaaagagcctaaatagaaatcttatctgtaaatattcattggtcctaattatcttttatagagttgcttttaccttactcagttgtgatttcattattaaaacttcaagtcacagaccaactaagtgcttctttggtgtgtgtgtttgtttgtatcatggatatccagaacatttgtcattggatatgatcattataaaactcttgaacatgacttctctgaccgtggatctcaggagctgtacttgaagtttcaaatcagctggcagtcaaaatgtttaataattcctttccaccgagcaaagatttctttcaatttctattctaggagtttgtactttttctaatgtatcctgcacaactaggtccatcaagataaatttctgtgcttaatgtcatgaatagaacagaaaatatgttaaaaagtgatggctccaaaggcatagcattttaatctaaaacatctgtgatttttcttgttcacagaatgtctgcctccctcattaatctgtcaggttttaaaagatctgggaatgaatctgctttgtttaccactatgtcttcagtgtctcacctggggaaaagtttgtgatagatttttagggaataaattagtttttgttggatggatggatggatggatggatgaatactcttatactcatcctgtaaatataagtgacataaaaatcatcacaaatagatgtattgccaggtggtttttgataatcaactgtctcagtccatttgtgttgttataacaaaataccacagactaggtaatttataaacaatagaaatatatttatcatggttctggaggatgggaagtccaaaatcgaggcaccagcaggattggtgtctgatggggattgctcttcttccaagatggtgcctcattgctacatccttcagaggagaagaatgcagtctcctcacatggtgaaaaggatggcctggagaaagagagtgttccatgtattcttgaacccttttataaggatgttagtcccattcagggccctcatgctgtaatcacttcccaaaagtcacacttcttaatacagttgcattggggattaagtttcaacatgaattttggagaagccaccatcattcaaaccactgcaaaacagaaatcagtcttacctggaagtatgtggaatggctttattgaatatgggttctttcaacagatagagataagataaggtcattgaacaatatgattcttatcagagcaaacagaggcaacggtgactgagcatggagatatgtgagaaagtttaacaatagtttggataaaatgtagaaataaaaccaggaggcccccgtcatggagagtttttgaatgttaagtcagagattgggtgttttagtgggtagataaccaatagggaacacaacaaggagtacataaactacatcatattcacattgaaaactgagagaattgaacggcagccacaatgaagtacatgaagagaagtactaactaaaaatagatatttttcagagatgcttttaccatttacaaatgcaggtacatgcactctctgcctgttattcattttccaagagggctccaggcaatcaacctttatcttttttgggacttcaaaagaggacaatgttaaagctgcattagacataccccaactgtttgtttatgatggcttttactgtttatatgcaaacctaaatatgtaaatcttagaaaagaatgctaaaagaaagggtataaggcaaggaaaatctggcaaatttttaaattttaggtttcagttaaattaaaaaaatagtaacattatctttcaaacgtgaaaatttcagttgcaaagaatagtacaaataaatcaaagtaaatgtagatttagttggctcatattaaaagaaatactaatcagtaacagtacagcttgatttgtcattggatgaatgatgaactggggaaattgaggcaatcacaaatagtctagcttcagtttacctcctcatgaagacttctcagaatactcaaacctacaatgaatcctcagcactttgcctaaggcttgagccttataacctactcaataaatatttgctaaatgactttgcccttactaactttgcagccttttttttcagttagtaataaaactactttgtattgttatttgatatcttcatttttcatctagacagtgtaagatgaaggccctctctcacacttttctttcatctcatacttctcatttaatgattaaaattggcaatacaattagcgttacataaattgcattgaattagattgctactgtcttctaccctagaatggaggattcaatttatagttgacctttcttctgaagcttaattgttgtttattattcagtttgttctacggaagttaccactttcttttacataggatttagagtgtatttataagttggattctctgcttttggaacttccattattcacttaaaacagattcatgctttagaaagataaggagacaagaggaagaatccccctgtgttttatgtcctacttttgtaatacctgctcttctaaggttgtgattttgttgctgttgttttatttcagtagttttttgggaacaggtggtgtttggttacatggaaaagatatttaggggtaatttctgacatttatgtgcacctatcacctgagcagagtacagtacacccagtgtgtagttttttctctctcatccccctcccactctttcccgattctccaaagcccattataatattcttaagtctttgcatcctcatagcttagctcctgtttataagtgagaatatacaatgtttgatttttctattccagaattactttacttagaatgttggcctccatctccatccagatttctgtgaatgccattatttcattcatttgtatgtctgagtagtattccatggtgtgtgtttgtgtatatatatatatatatatacaccacattttgtttatccacttgttggtcaatggatatttagtcttccttatttttgcaattgcagattgtcattttttgatttttttaaattatggccattcttgcaggagtaaggtggtatattattgtggttttggtatgcatttccctgataattagtgatattgagcaagttttcatatatttgttggccatttgtatatcttcttttgagaattgtgtattcatgtccttagtccactttttgatgagattatttgtttttttcttgttgatttgagttccttgtaggttctgtcagatgcattgtttgtgaagcttttctcccactctgtgggttgtctatttactctgctgataatttcttttgctgtgcaaaagctttttagtttaattagatcccatttgtttatctttgtttttgttgcatttgcttttggttcttggtcatgatctttttgcctaagctatgtctagaagagttttttctgatgttatcttctagaatttttatcgtttcacatcttaaagtctttgatccatcttgagttgatttttgtataaagtgagagatgaggatccagtttcatttttctatatatggcttaccaatttttccagcaccatttgtttaataaggtatcctctccccactttatgtttttgtcagcttggtcaaagatcagttggctgtaaatatttggctttttttctgggttctctattctgttccattggtgtacatccttgtttttataccagtaccttgctgttttggtaactatagccttgtagtatagtttgaagttgggtaatgtgatgcttccatatttgttctttttgcttagtcttgctttggctatgtggggtcttttttggtttcatattaattttaggattgtttgacttagttgtatatgctagatgtcaaagcaggaaatagatatttggtgtcagaaacatgaatctatttattcttgtgttctcatcccattttccctctcaactcaccatgagccaaatacaattattttctaagtaaacattttgacaaatgcattatatatttagctagaagaagtttctgccttctatgaggtcacagcctaggaagaaagagatttgataatgacccagttaattggcttgattacaaaattttggcttttagttagcagaattcctatttaactggtttttctaaccatctcaggattaacccatctgttcagtgaagatacttagagaaacctgtattctaagaggttattcaaaagtattctcagaggtacatgtgcatatatcttttgccagtacaagctagcaatccaatgggaagatgtttacctgaaaaataaagaggaaaactaatcccctcagcaagtgtttatcaactgtctttgccaggcaccacccaccagtgctctacatgtgatgtgagcatgccctgaaggagatcatagtctagtgcagcaattaaacagtaaagaaataattacagtacattatgatgagtccaactaggacacagaggaggagggagcattatagggtgcagagaaacattcccagagaactcagagtaggtaagatacatgggttgaaggagccgggcacagtggctcacacctgtaaccgcagcactttgggaggccaaagtgggtggatcacgaggtcaggagatcgagaccatcctggctaacacagtgagacaccgtctctactgaaaatacaaaaaattagccgggcctagtctcagctactcgggaggctgaggcaggagaatggcgtgaacctgagaggcggagcttgcagtaagccgagatcacgcccctcctgcactccaggctgggcgacagagtgagactccatctcaaaaaaaaaaaaaaagatacatgggatgaagggaacagcatgggcaacagaaggttaggagaagcgcaggtcatatggtatgactggcttgttgaattcatgattaggttggtttgagcaattgaaaagtgattaatgtcaaccacttctcatttttcttttatttgataaatatttcttcttacatatctggtcacaaacctttaatgaattccatgtaaaacaatcaataaattttcttattctttccctcctgtgacaatagagatggtgtctctctatctcttttggaacctgtccctttaatagcttctgagaaactttaaactataaacttttccctgtatattgcactgctagcttcaaaccaaatcactgccatcagcctttaaacatacttgagtctgtcccatattaatcttgatttcacacatgtgcccctacaacctctgcttctctttacaataaagacttgtacaagagttgtctctagctccacactgccacttaatcctggaccgctccaatctggctttcacctccatcactcaaccaagacagccctccacaaaggtcactaatgaccgccatgtctcttaataaaatagacttttcagtcctctccttgtttttttctctgggatatgtttggcactgtaaatcagtttatctttcttgaaacaatttcttatgttggtttccatgacatcccactcttgtttttctctatctttttgagttctgcctgcccctgctaatttccttttctaggcttattctcctttacctagttggcaattagaagttcctgaaggctctgcactaagcactttctctttgttctttaacttcttccatggatttgatttctgagtactctaaaaactcccaaatttaattcccagtgaagacttgcctttcagtatatctgggtttgtttaacatgcatctcaaatgcatttcccatttcttatatcctgaaatctgacctgcgccccttgttttctgtgtaggaaaattcacaaatatctatcttgtgcattaggtcaagagaccatggaaaactctttaaattgttaaaacactttagaaccgagtttcttaacctcagccctattgacattttgagctacataatttcctgctgtgggggtctctgtgcattgtgagatgtttggtgagcattcctggcctatacccactagatggcatagcaccccctccagttgtgacaagcaaattgtgtccagacattgccaaatagctcttgggagggataaggaggccaaatcagcccttactgagaatcgcagctttagaaggaagataagagacaaagctgtgttttttaaaaaatagaaatcatgctgaagttttctaccaaggaaattattagttcagttgtatgcccaaagtgtatgacattaagtattatttatcaatatcactacttcccacattagctacatgttgtgagtctcattggttatctaaaatatgcttcacaaaatttgcccagcaaagatttgtccagtgagcaccaagaaaccccatttggaccttgctgatagttccagcatatttccacacaatttctctcctctcatcctcctaatctcccaaccacagtcacagtgttttttgaaatcatatgctcctcctgtcatccagtgtcacccagtgttctttctggaacatcctgcccatttcacttaaccccccttcatcctgcaaacacagcccagacatcacctccctacagaggcctttcctaaaccccaaagccctttaggttttcatgcactcttagagctgtgctgctttccttcactggcacttacctaagtttatgattaaatatgcattcgcatggttatttgaatatttatcacacccaatagcctttaacaaggatgtaacacataagctctaaaacactggtgcctggcagtgacatgtatgattcatttcaaaacagaaaggtagataatcaggcacaaggactgctacctggctcaccagcagcacaggacatttgaaatcagcattgcactaaaaaatgtccttgttatagtggccatccgcagagtgctgaatctttcccctgtgtcgtgacgcctcttttatatcataatttttaaatcttcaaccatcatcctctaaaatactattttttcagagttgttaagttccgtgggcgaataatttgcattcattttaagacaaatttgtttaggcgataaatgcattattatttttctctacctcacaatatgacatggattttcaattgaaaattctgcctgaaactgattggagttgggataaagttgtagacaatctatagtagttcatttggtcacagcgtgtttgctttacttttggatcttgagaagaaaggactgttatctgcagggcactctgggacaacttcttggtgataagagtgaagactcatatttgctttgtaaatcaataaaaaagagacctttcaggcaaaagtgttgatgactgaggaggacaagttgtgaattttatattggaatgtaatgttacctatgaaattttccacctattttaggattttcatattttcagatcaatcaaaatttgttgtgaacaaggtttctcctccgtgtcctacgaactacaaaaaaatgagtgcctgtgggtgttttcaaactgcctgtgggtagacagagctatgttactacctggaactctgtgaatgtctaaaagaaagtcaaaatatcaaaatcgaaaaggaacttattttctttgatatgtcttgttgtatgaccttggtaggaacaatgacaaaattttgacatgttcagatgtcttagaacaatgaaattagtatatattaaaatagcagtgctttgttgtccttttaaataatacatgcattttaaagtattcagaagctttttctactttgtataaataccttatcagtcctctaaaataatccaagcttaataggaaaaaaaatgaaggagctttgttgaggcttactgaatgtcacagagcctgcaaggttagaactgagcatagaaagtgaagaaatatgttcttgatgcctattcaactgggtttcctgttcaaggttatgcactctatttgctaatagttgtagtattctgtaccacaattgctgagattaatatcttgagaaaatattgtaccattccagttaataattatgttgatttctattcttcagtttaaagtagatatatgaaaataggacctagtgtgtgaccactcaaaaaccctattttcctcacgtttgtagtgtatttctaaaggcctctccaggattatttcaaaatcaaaattgaaatattgtctaccaagatattgaattaattatgtatctatttcattttactgtttgaacactcccttctaatttgtatatagagagatagaattgtctagcacttttccgaaggaaaaagaaatcaagaataatatttaaaggctcataatatcttccgtctacatgtattaattgtatatggactttaaacaaatacaattaaggatagtcttgttctgcatataattgatttgcctatgttgatgagatgctgacaaccaggtatgaaagctggttttgcttatctaaaagagtggactaaaagtaagttaagtggtttctttagtgttctgtagctttagttgtacatggagcacctgctcctcttggaagtcacagcactttaagtaagttcgccatggtctgctatgctgcgcagactaagctgtgcagactatgctgcccagactcctcttcctcctctttagactgtggcagtaacctaaaagacttggcctctgtttcaactctcatgccacacatcatcttttgtctttcctgtggttcaggtatttgtgtgtgagggttgaggtgggggtgcaccaaattcatacagatttcctcagtagctttattttctgaatttgaggcaacaggacagtgaaaaatggcgatcgttatattgattcatacaacacagagatctgaaggaagcattttgtacaaaccctgctctgggtaacacaggaaatgccaagattttgaaatgtaactttcttggtcttgaagaccaaattgtgctcagaaaaggcagagtccctataagttttgtcacaataaatgagtagagcccactgcaggttggaaatctacaaatcattgcagggtattattaagataataactgcacgagagccatcacagcagcagaggtaaggatctctgccaagattcaccttagaccggtgattctggaacttgagcaagcctagactcaccaggagggcttgattgctagagtaggagaattttccccgtcttacatataaccaggtgatactgaccacacttggagaatcactgccttaggcattaggatctgagactatatatccatggattgcagcaagaagcagacaaaaacatttcttcatacacaagaatgtttgtgacttagcaaggctgttattggagacctggccattttaggtagttttgtataatttgccttattccatccaatgttctaatttctaatgtttataggctgcaagcctagacgctactgttgtgaaacagttaaacacgttgggtgtggtgccgagctccttcctaggttatcaaatccaagctctgccatttattaattgtgtcattttgaggcaggtatttatattcttagggccatggtgtcttcatctgtagaataggaataatagcacctattgctagtattgctattaggattttcaaaataacacacataatgcattggagaaagtgcctggcaaattataagtatgtaataaaacttatctctctttttactccttatttcttattacagtggttttgtttttcatttcttttattttttggatagttaaaccttataaggatttaaaagtttcatgtgaccattcaaatatcccaatttatcatttaaacgtaaacaacaatggtgccagagtagtcatggggccctctccagcttcatcctacagaggagccccacctgggcaactgaaataagattataagctactagaagaataaagaggtcttatttcattatttaattaagccgctgaatagtttattcttcctaaagcaacatcacatataccaattaggttagatacccttattaactagccagggaaccttctctcttgaaaaacatcaacaagaagtttttgttgttatttttgtcattcttgtttggttcaagaaatataattaaataaatttattccagaaattttaaatttcagttaaaaatttttaatttgatgttatatcagagttatgaaaatcatggctaactataatatggcctgagaaaatccacttatttcaaaagggaataaacagactaaaaaacaataagaaaacaaaaagcagatgagtgtgaaaattacaagataaactcagaatacacctggtcaaagcaaacattacactgggcaaagttacataggcaagagaggctttattcaaaactattgtaacagaagagagaggctgtaactcagcctgagctcaactccactgaaacaaagggatgaagagtttttaagagctgggatgggagaatctgtgtaggccatttgtgcttgctaattggctttacccacagatgaagtaaattttctcctatcttcatgacaggaggtagttttacaacttagagcaaggctctttgaagttaggctcccacccacactcaggtgtagactgtatccctttaatgcttttatttcaaagtgatggctcctgggtgcttaaggaaaacattccagggttttaaaactgacaagaagctttaaaaaaaggtttacatctcaatcgggcaaagaaagagtttcaattacttgttttctaaagtaaatgctttaagaaagggaagttagggacctagagtcaggaggaagcctgtataaagtttagtccagctgagggaactgctaaggccatcttggtctcggtgaacacttggttttcacatagttttaatcacggaactagtatgtggcctggacacacttggaaagaagccaacaccagagggattgctgatatactgtgaatatctaattcctacatttatgataatgaggtggaatgaaataaagaggagacagtgtgaaattggaaagtatgtagtttgatgttacttgcaagtatactgtgaggcccaatttatgacactgggctgcatagagctttttctgaaagtccatctagctaaaccctgtcctttaaccatatgggccaaatgacttttgctttattttattttagggaattttctttatttgtaacattcctttcagctctttttagattctaatattccagaatgtcttttttccagtgtaggttcttggcatctttgtccaacatttcatagtaggtgtataaatttgtttttggtttctgaattctattccattgatctgtttgtccacttgaatgccagtaccaggccattttggttactatagctctgtagtataatttaaagtcaggtgattcctccaattttgttatcttgctcaggatagctctggctattctgggtatttttgtggttccatacaaatgttaagatatttttctatttctgtaaagaatgccattgatgttttgataagaattgcattgaatctgtagattgctttgggtagtatggacattttaacaatattgattcttccaatccataaaaattgaatactttccattttatggtgtcctattcaatttctttcgtgttttatacttttcattatagagatctttcatttccttaagattgatcattgttggcatatagaaatggtactaatttttaatgttgattttgtttcctgcaactttacataatttatcagttctaatagtttttttgtgtgcagtctttaggtttttccaaatataagatcatactatctgaaaacaaggataatttgacttcttccattccaatttgaatgccgtttatctctttcttttgtctgattgttttatctaggacttccattactacattaaataatagtggtgaaaatgagcaacttcgtcatgttacagatctcagaggaaaggctttcagtttttccccattcaatatgatgctagctgtgggtttgtcatatatggctttcattatgctgagatatgttccttctatccccagtttttgagagtttttatcataaaaggaatgctgaattgtatcagataatttttcagcatcagttgaaatgattatacggttttggccttcattctgttgatatgatgtatcacattgatttgcatatgttgaatcatccctgcatctcagggataaatcccccttagtcatggtgaattattttttttttggtttgctattattcaggatttttgcatcaatttttatgagtgatattggcctgtagttttatttttttcatgtgtctttgtctggttttggaatcagggtaatactggcatgatacagtgattttggaactatttctctcttcctctattttttagaatagtttgagtaggactgctactagttcttcattacatatttggtagaattcagcagtgaagccatcaagtcccgggctttttttactgggagactttttattatgcttcagtttcattacttgttactagtctgttcaggttttgaatttatttgtggttcaatctcagtaggttgtatgtgtctgggaatttgtccatttttttccctagatttttccaatttattgacatatagttgctcatagtagccactgataatcctttgaatttctgtggtattagttataatgtctcctttttcatcctgattttatttatttgcatcttctctctttttctgtagtctggctaaaagtttgccaattttgtttaacttttcaaaaaaccaactttttatttcattggtcttttgtattgttttcttcatttcaatcttatttatttctgctttgatttttaccattgattttctactactaatcttgtgtttggtttgttcctgcttttccagttctttaagatgcattgttaggttgtttatttgaagtttttcttattttttgatgtaggcacttatagctatgaactttcctcttagtactgcttttgtcatataccataggttttggtatgttgtgtttccatcatcatttgcttcagaaaaattccaattttcttaatttttttattgacccactggttattcaggagcatattgtttaaccatgcatttgtatagtttccaaaattgctcttgtcattaatttctagttttattccattgtggttagaaaagatgctggatattatttcaatttttttaatgttgtgagccttgttttgtgacctaacatatggtcaatccttgagaattattcatggtctgaaaaaaagaatgtacattctgtagccgttggatgaaatgttctgtaaatatttattagatccatttggtctatagtatatattaagtctgatgttcctttgttgattttctctctgaaagatctgtccaattctgaacgtggggtgttgaaatctccagctgttattgtactggggactacctctctctttagctctaataatatttgctttatatatctgggtgctccaatgttgggtgcatatatatttaaaattgttatatcctcttgctgaattgacccctttatcattatagaatgacctttgtttcttatagttttaatcttgaaatctatgttgtctggtataagaatcgtaactcctacttttgttttggtttccagtggcgtggaatatctttttccatcccttcattttcagtctacatgtgtctttataggtgaaatgtggcaacagatcattgggtcctcttttttcatccattcagccacttcttttcattggagagtttagtacatttatattcaatgttattattggtaagtaaagacttactcctgccattttgttctttcttttttgttgttgttttgtggtcttctcttccttgtttccttcctgtcttccttttagtgagggtgattttctctgattatataatttagtttcttgttttttattttctgtgtatctgttgtgtgtttttttacttctggttataatgagacttgcaaatactatcttatagcccattattttaagctgataacaacttaacatcatttgcataaacaagcaagcaaaaggaaaactaataaaagctctacaccctaatttcgtcccctggtttttaactatttgttgtttctatttatatcacactgtaccatatgtcttcaaaagtagttgtagttattatttttgattggtttatcatttagtctttctagttaagataaaagtagtttatacatcatggttaccatgttatattctatttttctgtgtacttactagtgagttttgtacctcttggtgatttcttattgctcattaacattcttttctttctgattgaagaactccctttagcatttcttgcaggacagatctggtattgatgaaatccctcagcttttgtttgtctgggaaaaatctttatttcttcttcacgttcgaaggatattttcaccagatataccattctagagtgaaggttttttcctttagcacttcaaatatgtcatacgactctcttctggcctgtaagttttccaataaaatgtctgctctcaaaggtattggagctccgttgcatgttatttgtttcttttctcttgctgcttttaggatcctttctttatccttgagcttttggagtttgattattaaaagccttgaagtagtcttctttaggttaaatctgcttgttgttcgataatcttcttgtacttggatattaatatctttctttaggcttggaaatttttcttttattgtgtctttgaataaaccctctacccctgtctatttctctaccttgtatttaaggccaataagtcttagatttgcccttttgaggctactttctagattctatatgcatgctttattctttttgttttcttttgtctcctccgtgtattttcaaacagcctgtttttaagctcattctttcttctgcttgatcaattcagctattaaaggactctgatgcattcttcagtatgtcagttgcatttttcagctccagaatttctgcttaactttttaattatctcaatcttgttgttaaatttatctgatagaattctgaattccttctctgtgttatcttgaatttctttgagtttcctcaaaacggctatttgtgaattatctgtctgaaaggtcacatatctctgtttctccagggttggttcctgattccttgtttagttcatttggtgaggtcatctttttctggattgtcttgatacctgtagatgttcatttgtgtctgggcattgaggaattaggtatttattgtagtttttgcagtattggcttgtttgtacccgtccttcttgggaaggctttccaggtatttgaaattacttgggtgctgtgatctaagctgttccttatttagggagcaccccagtaacactatggttcttgcagactcatacagattcatcttgatcgtcttaaagaagacctgggcgaattctctggattatcagatggacactcttgttctcttcccttactttcttccaaccaaatgtagtctctttctctctctctctctctctctctctctctctctctctccctccctccctccctccctccctccctccgtctctctctgttctgagccacgtggagctgggagtggaatgacgtaagcacccctatggcaaccaccactaggtggacctgaagccagcacagcactgggtcctacgcagcatctgttgtaatcactctctggctactgcctatgtttcctcaaggccctgggactcagcagggggcaaaaccatctaggactgtgtccttcacttcagggttgcaagttcccctaggccctgggtgggttcagatgtgctgtctgtgagccagggactagagtcaacaaacttaaatgtctactttgtcctcttttgtcctgcagctgagctggcactcaaaccacaagatacagtccttcccactcttctctcccctttccaaaggcaaaggagcctcagctcatggccactgccactacaggtcctcagtgaatacttccagcctaccaaaaatgttccattgaggtccaaggactcttaagtcagcttgtggtgaatgctgcctggtttgggactcatccttcagggaagtgggctcccctctgaccctggaaatgtttagaaatttcatccaggagccaagtgctggaattagggactccaagagcccattttgtgccctactctcctgtggctgagctggtacctaagatgcaagatgaaatcccctttgcttttccctctgcctttcttaagcagaagtctcaccccatagccatcatagctggaaaagtgctgagtctcacctgaagccagcaagtgtgaatctcacccaaggccctcagtgtagtaccaggtattgctgctggttatttgagcccaaggacacttcagttaccagggtgaataaatcctgtcaggactgggtcatttccttcgaatgagaaggttgctctctggcccagggtatgtctagaaatgttatcttgcaggtagggcctggaaagggggcctcatgactctgactgctgccctatcctgctatagaagagctgctatccaagaggcaaaacgaaatcttctccagtcttctgtctcctgtcctcaagcagagaaaaggggtctcttttggagcagttagttgtacagcctggaattaggggagaggtggtgcaagcactcctttagccaccctggatagcatctcaggaggttgtgtgccccaccctcacccccagtcagctgggtttgggcccagttcagcactaggacttaggagttgcggtcttcatggcctatactgcctttcaagattatttagggccgggcctcagggcactttagccagcagtagtgaggcttgtgggaactcaagcactgaccactgggatcagtgattcccctctggctaatgctggtttaaatggtccctccatgggtgggtgtcagcggagtttgatctggttttcctttctgctataacaggacaccactgagtccaatgactgaaattgctgcacgctgtctctctcctcagcacatggaaatgctctcctcacccatgctgccactgcctgcaggtggtggaggggtgtcgtcatggcaattagtggcaatagtcctgaataggcaagtaaggactatttttttttctccttctgagtgactctttcaataataggaagttaaaatccagcactgcgagtgttcatttggtttttggtccttaggaaagtgcttctctctgtagatagttgttaaatcggtgtcctagtagggggatgatcggtagaggcttcttgctctgccctctaatttgtaacatttttttagctctttttagattctagcattccagcatatggcaacattttaagcattaaatttctgtataggccttccagacatgggtaagtgtgtgtagagatatgtttgtgactttatgtttcctttaatatgcaatttcacatttaccaatcctaaaacattaaaaagagcataatccaaatacagtgttcaaataaacactgcagttatttgttagcaaagcaactggctgtgattctatttcaggaagattatctcctccaagacgtagaaatttgccagctacatttgtttgctactgattcctgagtttggtttgctttcattcttctttggatctcagtctcctatgcaccattcacattttctattcccagtaaaaaggtttttgtatggtcttggttttgttcctatcagtcacttaaaagaacagacacccaaaggcaagggcattaatcatctgtttgaaggtccctgggaaattattatttatatgttgatagtgaatctattttaccctttaaggggcaaaattgctagattaggaacatggttaggaaaacatagcagtcattaaccttatcgcttttccaacaaagaaaaactgtgtaacaactggccaaagcccgtggcaatttgagaacacaagagatcaacaaaatgaagcccaagatgagataaaacaagttgccagccttttggcataggtttaaaataattttctgtaaacacctatcctcaaaaatggaaatcagtgaaaatatttcataaaatggctagagaattctaaagcttacattatattctttagtattttatataagaaaaattttgtttgctttagaaatttcataacgtatttcttttagtctaattaaattttctttttttttttttttttactagcatcattccccttagtcactaagagtgaaattaaaaccactaaattttatttttttaggttgttggaattacaggttctctgaaggggttgctctgcatagattattgacaataaatatgttccaaaaaactccatgccaatgagatgagaggaattattgggcaagagccaaagaggaaccagggagatagcaagtgcaggaggaaagcacaggtatggaaagtgagtgaaagtaaaggatgatgtattagtccgttatcacactgctataaagaactacttgagactgggtaatttatgaagaggtttaattgactcacagttccacaggctgtacaggaagcatagctgggaggcctcaggaaacttataatcatggtggaagggtaaaagggaaacaagcacgtcttcacatggtggaaggagagagaaagagtgaagggggatgtgctacatgctttcaaacaaccagatctcttgagaactctatcaggggaacagcaagagaagaatccgcccccatgatccaatcacctcccaccacatccctcccccaactatgggattaaaattcaacatgagatttgggcaaggacacaaagtcaaaccatatcagatgactagccgaatgttaacctgatctgtcctctcagcagggacaggtgccctcctgctttatggatgatttaaagttattataacagatggtggtgcttcctttcatcttttactttggaattttagcattaatttaaaaaatatttcctatgaaacagtgagacaataatgctagaacattctagtggttcataaagagcctttacaggtaggattcacttggttagggcgccacattacagatttgatcccaaaattgtggatctagaaattttattttcacatggtattttatgtgggttagacatattagaataccctgcctcagtttccttgttggttgttgtggacaaaaataaatgtacttagcactgttttgaggataaaggtgttagaacactgcttgacacaaagtacttaacaaatgttagttgtcattcttagttttattaacattctcaacaggcatatgctgatttattagcttatgaaaaatacatttaagtgggtccagaattattttattctcctttcagaatactctgttcatgataccaaaataactgagaagctgcattagtctatctatgtttctttccttctttctctctttttcttctttctttctctttcttctttctttttggagacggggtcttgctctgtcactcaggctagagtgcagtggcatgaacatggctcagggtagccttgacttcgtgggctcaagtgatcatcctggctcagcctcctcattaattttaagatgattctactatggagaaaatttaaagagtgatcaaaggttctgagtggttgtaggagatgttttatttgggatctgaagactctgataaatcgcctaccaccctacacctgcataccatcacagaacagtccacaagatgtcagttgcacaaggatcagggcaagacacacttgctctttgtttctttcttttttttttttttttttaacctgtgagtctctgtatgtctctctcttgctgttgctctcactgtcggcctcctctctcctccccccacccctcactaacttttgagctatcatgttttgtttcctagattccaaggtggcactcttccttcctaacatcctttttaattccacttatgccattgcttatgttaaggtttcctgcaaatgaaatgaatcgaaatgaaataggatcaatttcttcttgcttttagctgggagagtccttaagtgtatcactgaaagtggttgctggtttgaaacaatatttttgggttatctggggccataagtaatgacatttgatttgtccacatcatcaataatggagttagtagtagactgaggttcaagaagttgaagacctgagacccatatccaagttttccactgtttacaaccacgactgcgagaggacctaactgttgtatcttccttacaattagaagagacacaacttttcccaagaacaccacctcaagagactgtttacattattgaattagactaagctttaacatacagtgagtattcagttaaattatttctcttcacatcagctggtagggacttatggtgagtacaaaatcagctatgggcaaagtttaaaatgttatattttctctggacattaattataatagaagatacatcttatgctttccacataaagaagtagcatgttaggttaaaagaattttagggtgtctgataagaaaatcaaggtcagtgtgactaaagaagagttaaagagaggactaggatggtttatggatgaagagatggcagaggctgcatttcacaaagccttgcagactatggtaatattttccattttattccaagtgcattagaatgccaagaaaaggcattaaagaaggaaagtagtacaatcagatttttattttttttaattactatgacttctatatgaagaagagattcagaagagacagattcagctgtgaactagataaggggcgcttatttcaaccatgatggagctagtagatgcacacaagtggacagatttcagaaagttttagagaatgcatgcgtaaatagcttccacctgcatgctcttgtgtacatgctctacatgtgaatatatagatctacttacatatacatatgtatgtttgtatatagatatgtatttgtttaggaacatacttagaaaagaagatagaaaaacacaccaaaatatttacagtgacttcaatatttaaggttatagtatttggggttatgtttacttgctggtttgttttgagatggagtctccctctgtcacccaggctggagtgcggtggcacaatcgtggctcactgcaacctccgcctcctgggttcaagcaattctcctgtctcagcctccccaagtagctaggactacaggcgcgcgccaccaagcccagctaattttttctgtaattttagtagagacgaggtttcaacatgttggccaggctggcctcaaactctggacctcacgtgatctgcctgccttgggctcccaaagtgctgggattacaggcatgagccactgcacccagcctatttggggtaatttttgctgccttctttacaatttttcttttcttaatattctacaatgaatatatgtaaataaatatatatagtatatatagtatatgtacacacttgtgttaatgaggcattatggaaattaaattataaatatggctagtatcaagaaagtcctaattcaagtttcattacaaaaattgtttcccactactcaaatatgataaagcacttttaacataaacaatttttataggcaaattattgtgttggaggccctctcaattggttcatgatcatgcatagctcctaaaatataagaaggtaacaatttataatacaatggatttcaatcgatgccctttgccattaaatcacactagaattcaatgacacaactgattaacaattaaattaatggtggtgaccttgcaaatgaaaagtgatatatagtatttatattttcctcatcttccctctgtttctgaaaatgtaaaaatattcttttaatgtttgtagtttttaatcttaaaaacacaatgttgaagaggaattatctggagagtgctagattagagtcaattaagatttccaaattaaatttttaaatttataactagagagatttttaaaatgttagcagtattttttccccagattatctatctgcataagattctagagaattctgagacattcttcttgctttagagttgggtgctacataaacattaatcagtgctaagtaaaaacaaaccaaatatgtgtgtgtgtgtatatatatatatatatatatgcacccccattgtttagtatcagtaaattttactagaaatactgaacaagtatatggcaagcaattgacaaaaatattggttcctgatctccttttaaatagtatctatgatgctaaataaaaagtgttctaataatagaggaaatattttcatattttaggtcatatacatatacacaacataatagggacggggagaggcatcatgaaataactcaaggtagtatactatctgaaaatttatacttatgaaaatttatgttataaaaataaagttaaattgcttttttaaaattgctttagggtttagctctctgtctacatagttggcaaccttgggtgacttattttattgtaatctattgttatgttaatttcccctattgctacttgtataatttttatatacataaggcctcaataaataaactctttgaataaaaaagaaccctaagcatctttttgcaaatagttctaaatcatgaaaacactaatattttataatgctctaagaagctaatgaaccagaaatatctttaaccaaaggcacttttcctttggttttcacaaagcagagaatcctaatggacaggcaagataaatcatttactgtgtaaaacactcatatacctattgaaagggtaaccacatcaaatgttctctggctatttaaattacctacaaaaagaaatcttagcaaagtgcaaaatgtgatagacatttgcagtctatctgtaactagcccaattccttcaaagagaaatgtgaacataaaatgcaaaagcatgactgaggagtcatttcatgcattccttgattcctcagaatggctacaagcaacgttctcatctagtgtggggcctcactatgcaaatctgccaaggttatccccgtgggcaacctacaaccaacgtgtctttgccttgggctcagtgagttgactataatggttatcctggcaagacggagctgatcctctctcagaagtagacgataagatattatccagctaaaagttaaaagtggaagacagcttacacttcaaggactggagaaatcaaattcagtaatgccatttctcagaggaagtctcagattaaggacatagacaataaagctttatataaggaaaatatttgtttaaggttgaaaaggctaagatataaacatccagtcagtttgatttaaggtggaaaaaaaagaatctaattcttagaatggagctagggatatcagtggaaactcttcttccctacacaagtgacttgacatgtttcttgtttttgattctaaagttgttttagaaattcagatgtgaaaatacaaacattctctgcttttttctcccttgtagctttgattcctcaatattcaatttgtcagccaatcacattaactctatgtccaattgatttcccatatgcctgctttattttctgtggttaccacttcgggacatccttctcacttcaatccccattcttctgtggtaggcaaaaatttgtaaatcccccaaccaagggtgtcctgtcctgatccccaaaacctgtatttatgacaagatatcactcccatgatcatgttatagtatatggcacaactgactttcagattatccaaatcagccgaatgtaatcacatcactctataaaagcaaagaacgtttttttcccactggtggaagaagagaaagtcatagagattagaaatatgagaagcactcaaatgccattcctgacttgaagttggagatatccatgtgagatgcaatatgaggagcctctaggagagaaagtggccctgtctggctcacattcagccaggaaacattatcctcatgctacagcaataaagaactgaatttttccagcaacctgaattaccttgcaagagagtttttccccagtgccttcaaatgagaacccaccctaaccaaccttgatttcagccttatgagaccctaagctgagaactcagccaagctcacatggactcctgacctatagaaactgtgacataataaatttgtgtggttttaagctgatgagtttgtggcaatttgttatacagcaatagcaaaagaagataccttcccacctagccatattcatcagatcagcctttataaatgactccattcatcttaacatttgactatgtaaaaatctacaagtcttctcaatgtttcagaccaaattcaaaacctttattttgactttaagatgccagtaaattaataagccaaagtttcttatcctaccaaaatttttactattcttgtataaagatgctcctctaatactttgttgcatttgttctcccatttgtcatgttataattttctatgtatttgtctgtcacctccattaaactggacattaattccttatattctcagtacctaggacatcacttggcatcagtagatctgtaatcccactcatggatgaaacaactccacattaaatccaggccagacccttactgttctttgaccaggccatgcagagctcctgcctctttgccttggctaatatgcttccctcagctggaatatctcatttcttccactatctaccaacgtgctgagggaagagtcaatataagacagtcaatatacgggtcctttgttgaggcaaaaaactactctggattaatgtctccttacatgattgcagaacacaactaaaaaatctgcatagaaacaagagcccactagtctggagccatagagtctccttgacactgaaaggatacagcccttcggggatatgtttgtcaatttcttaacaagtctatgaatttcttgagtaaaagaaccacattttctattttttggataccactaataatatctcgttggcatagaatatatgcttaaggaaccaaatttgcacttaagcttcacaaatttcagacaacatagcaactggtgtagttatcttactgctcactttgtcactatttctttaattcaaactccctccctgccttgacttaccaaactgaagctggatgggagaaacagtgggagtaataatacaactagggcccagagaaaactttctcaagatcacgtagctagaaacatactggacccaggattgaaacctgtggtttctgacgccacagctctgcccatcataactcccacaccttcttgcctatccccacccaactcccagtccctaacagtctaggataagaatcctttgtattcctacaaagaggttgctatgatttgaatgtttgtttcttccaaaaaaaaaaaaaaaactcacattgaaatttaattgccattgtaagaatattaaaaggtggaacctttaaaaagtgactgggtcattagagctccaccccgctgggtaggatatgtgctatgacacagggcaagtttggtgacctcttgccgtctcttgctcttccaccatctgcaaggggaagaggcaacaagaaggcccttgccagatgctggccccttgatcttgcacttctcagattccagagctgagagcctatacagttccatctattacaaattaccccgaatcaggtattctgttatagcagcagaaatggactaagatagtgtataattcatgggtagaaaaataatgaaatgacatgagtgttttgagataggctttcgactacaaatattagagacaaaccctaaaaaggattacatagaactatctttatatgaatacacatatcagacagatagacattcaaacttcctctgtccaagtcctatacatgccactccttagtattttcagattgcatcttagagaaatcattattttatatcaaaaagtagctggccttgacagagtataatcaggttcacagtttatggttctactgtgattaaaattagaactttgatgcttgttttatagatgagaaatgaccttcatataatgtacattgttagtaaatgatttctaaaaccacctagggcatttctttaaatctaattaaaagcacaatttcaaaacaagcagatcaaaatgtttcctataaatcagcctggtgtagtactaataaaaagtaataaggagaaaatattttaatatttacatatgaaaagaagttcatgctaaattttacaaaaggcagttgtacctgctaattggatgtgttactaaacataatttatgcaaagaattcaccttttggtgtaacctaatatatatatcagtcattacattacattgatattgctagattatggtggggatcaggtctccctagcttactgcctgatatgtaagtatgcaagaaatgttacagaatggagatagaaggtaaagaaagacaaacgtagagtaatgtggaaaggaaggggacagagtgaagggagaaaataaagaagacagacaaagaatataaaggaatgagaaactagaaaaaatagaatgggagggagggagaagaaagggagggagggggaaggaaaggaggaagggaagaagtagaaacagaaagggagaaaggaagaaaaaagagaaagggaaaaagagagaaagggaaagaaggaagatgtgagaaagtagaaaagggagagaaatggaaggcaggcatactccttgccctctttttccctttctcctgctggcaaagcctgctcctcagccagatgaaagatttgttgtcttaagcatgccatgttctgcaggtctcatagctgcctatttataccaacccttttcctcctggtaaacttctcctcattgttaaacattcaaacagtagtgcctcccctagtccaggtgcttcaggaagaatcagagacaccggccttcctgcttccctatgacttctgctgtctcagagagtcaagtgaagttaccattagatacttttctcattattgtgtacctgttgctgtagtgataggtggtctccccattacggtgtgatctccttgagtcaggaaatggtctcagcactttgtattcctagattcttgcacagggcttggttcacaggaattattcaataattctataaattatcacattcagttctcacaactaaccatgtgaattaggcgttatattctacatttcaaaagagaataaacctcaattcagattatttaagtgacttgtacagtaacactcgtgtaagtgagcctgaaaataattcttttgttttcactgatgagatctagaattgaaataataagttctaagaattaaagtacaacaaactcccatgacacaagtttatccaagtaacaaacctgcacttgtactccaaacttaaaagctaaaaaaaagaaaatgccaccaaaagttctttaatgtatttttaaatgataagtggaaataaggccaaattgtggctgtttcattgtgaatttttgagaattgtattcttcccacgtatctatatgagaaagggaaaatttgtgttaatttatgaaacagaaacctaagatgcgccatgttctcttatttgttatttataggaactggcttataaaactggggcaaaaataaaataaaaattctacaactgaaagcatttgcatttgttttagacatagagttttacatcaactaaagatttgtgaatttttggtgtgttctttcatatattaattcaataaatgtttcctgcccatatatgctaagtaagcactgactctctgtttaatcttactttagtttacacttgttaaaatattttcccatgccatacatttctagttcaaacatggaattaattttctttggtggctttttgttggttttccaatcttatattttgtttattttgcaataggacgtcgagtttaagtaaactatgtgttcagccaaggttatgcattcctcttgttttataaattgtcattattcatacaagactttgctcttttctactgtattatacagtattttgtgattttctttattttgtcttataattacagtttgggatatatattcagtatatcattttatatttgaccaaaatcacaaatctattaatattgctaagacagttttccaacagagctatgatttccgagtatttgccctataacttcaaggatacaataaaatttaacttaagggcttaaaatctaagcagaactggtgctgtttcatcaggcaatgcattgaatggtttataaactgaacatgaaaatgtctaaaagaaggcgtctcccagagcccattaaccttcaagacgccttagcctttctctttttttttttctgacatgagtaaagtgaacaggattttaataaaagtcctgcagcagatattcctgaaaggtcagggctcatgataaagctgccagcactgcaactttaagaaaagagatcccgacgacctttaataacactaggtctgccagtgctcattgtagaggatctgtattttaaaattccatttgagaaactgactcccccatttgacaggatcatggtctttaatcttacttttggtgtgtaagagctggcggtatgccccatggaaacttgcattttgtatgcttctgaggaccttgggaaataattttctctagtgatagaaatgcttccccgtcttcaactttgactttctgatcacccatttcattaatactaagtacaccatatctgaaagtagaaggaatttaatattgaagaagtagacttgattcaccaaagcttctatttcatttattttcattttcgttccttaatctctcttcagctttttatagattgaataactctgaaatcaggaattagtgatatacaacagtaatttccacatctatgttttcactagcagaacaaaggtacaattattactaaaaatatatttgttattataactccaatttaataaggggtaaacaaagactttaaaaacttcagtaagttgctcgagttaacataggtaataaataacaatgccagaatttactgttttcagatcactcagtttcaaaacctcatacaatttccattctctaagatgtacatctacatttctgtcttcatcatctcagtttaaattaaattaacaaataactctttggaagctagaataacattatgagtaaaaagtaaaatcttgatgtaaactattccagagaatagaaatagagggaaactttccccattctttttgtgaagtaatttcatcaatgaaaaatctggcaaagaatttaccaaaagaaagcaaaaacaaaaacaaaacaacaacaataacaacaactcagaccactctcaccagagtgccaatcgaaagtcttcaataaaataacactaaataaaattgaataccacattataaatgatatcacaccatcaagtgaagattcttctagcaagccaaggccgttcaacactaggaagtctaatagtataattcacatcataataatagagccaatgagtaaagcaatatcataatctccagagatgttgaaaaggcatcagacaaaattcaatactagtaatttaacaaaaacaaaaacattctgtaacataagaattgatgaattgatgactcctttgtaaacatgagagtgtacttgtatgtatgtatatgactatatttgtatatatagttttgtttatatcttcatcaaaagccatttatatctccatcaaaagcagtatttagccagcatcttccttaaaggacaaacactagagacctttccactagaacaagatggtgctacccactgtttttactgtgatttaatattatattggagatctatgacaaagaaagcaattagaggcctacaacttggggagacagagctagaactacctctgcttacagatgatattattagttacttgaaaactgaaaagtatcaatgaaacaactagtatatagaaagagagaatttaagaagatggcaagcataactttaacatacagaaatcactagcctacatgtaattacaaacagttttgaagatattatgaaggtgagcagaaaaccttttaaccttaattccaaataatagtttttcaattttttttctttcattggagaggtggggcaagtgtgatgtgtgcctagaacaatgagattttgtgactcagaagaaaggaaagaggaaacatctcagtagagaaccttgcatggggaagagggaaatttgttgctgtgaagcagtactttagaaaaattaatcacagaaaaaaatacaactagatactttagaaaaattaatcacaggaaaaaaaatacaatcaggatgcgatgagaacctgaaaaggtgaagcagcagtgttaatggaatggacgggataataggagacatttaaaaggatcaaccatattaatggctggaatcaaacatttgtagaaagaagtaaatcaattaaggcagggacagaatgttaaccaggaggtctgtataatcatttggtgataagtgtagaaacaccagtaaaaggagtgctatagaaattgtggtcaataactattccactaagagtttctactagttcacatctcttgatgaaaatcatttaaaagttacaaagtagtcaggccttcgatatgaattcaaaactaactggaccagtacttttcctttttttctgatattttcctttgttctcatatgtctattccaaaaagccaaatataaatgcctttcatttcactgtgtcatgctgagaaaggcaagatgaaaagggcgagaacaaagaaaaagaacagatgaaaaagtaatgttggaagttgtaaaggagttctctgggcttttttcccatcacttacaagttggaaggtgaaaattaaagctcaccagacatcaagaatgtcattttccttcgactcaatgtgcttccattttgggttctttgcagttgtaacgctcagccggaaattcttcttccgccatatcctacatcgctgatcacttggtcaaatgccacatcaccagaaaagcccatctcccactgttctgtatcccctgaaccttgctgtatttcccactgtagcgcttactgtatatttagttcataatttatctcctgtcgtgagactacaaagttcaagatatgagaggttttttttcctgtttttcttatattcccttcgctgttgcattctgagagcctgaaactgttatctgccatatgataggcatccacgagatattggttaaataaatgaatgaacaaattaatgaatgagcaagccctagaaacagtattctacaaagttcttacaattatattttattttgtaatcaagacaatttcaagaaagaaaaaacaattagagcattttccctttaaaaaatactaagcaatatctatgctacatagtttattttcaatgaatcaacaaaaaaaaaatctgatctttcttgaattcttgaagttgaccagttttttcaaaagggaggcagtgattagttttgggtggccacatctcctcctgcctgtttccagctctttctctttgtattagggtatttctccttttcattcagactcacatttgttaagcttcaaagcactccatggtttattatggatttttcactctaggaaagaggtcatcactttattaaacattaaataatggtgataatcaataataattgatatattgtctctattggtactatcagaaaaaacaaacataagcatttcaggttactatgtgcatcaagaattctaatgttttgaaaatctgcataatatatcaaatgtgctgtgatttatttatctacctgtttagtgttgaacagtaaattttattccattttttggtgttataaatagaaacgtggatctctcttggcacttgtccttatgtccaatttcatcccaaattcatgcaaaattaatcaaattgcaagctcttgatgcatagactcacaagcaaaagtctacttattgagatactgtgttgataacatgatataactttcatgttgcttctctctaacttatgaacttgttgtcctttcatcagtgaaaatgaaaatgaagaactatcacttaagaaagttctactacagatacaccagggctttgatatcagacttgacctgaagggctcctctagttatgagctgagggatgagaagcggacatgcaggaagatccccttggcatggcaacctttgcaaagcactgcctgatagtctccctcctgctgtgcccagtgtcaagagaatgagcttataatattttgtaaaatatgtagattgagaaatcggaatctcatttatcccagaaaacagatttcctagtatcaatatagcttaactttttcttgaaatgaaggtcattttacgaacataaatttttctccaaaatgaattcaaacagaattttaaaagtatggagctggcataaatattttgtgaactgaatataaacactttgacttcatttctcatatgtatttcacatgcatgaaatcaagagagaaagaaattccattggcattcagccaaggaaattgattttttttttaccactgtgccactatattatggtttattatctccagaatattactctaaatagtgctacccaacagaattttcagcagtgatggagatattctgtatctgcactgtccaatatggtagcctctagccacacatgattgttgaacacttaaaatatggctaatgcaactaactaaggaactacattttaattgtatttaattttagttaattttaattttggttttaatatttgcatttggttagtgggacagcccagccatcgggtaggtcattccatttctgcatttcttttatcctctctccacattctgcttgaaagctgagaaagctgccttgtacctccagttctatgatttcactctggatactgctagaaaagtagccctttacctatgacagaatggtggtttccagaatgtactaatccccaaacctatgaatatgtcacctgacatgacagcagagactttgcagatgtgactaaattaaggatcttgaggtttagagattatcttggaaatgtgggtgagctcaatatgatcacttttcagagggaggcagtaaggttagaaatgaagaggagatgaaaagactaccaggaccaaaacaggatagagaggaaagaagatgctacgttgctggcttgaatatagaggaaatgggccatgagccaaggaatgcagactgcctttcgaggttggaaaggcaaggaaacagtttctctccaacaagaacttccacatttgaaacttctggcctccagaattttaagacaataaaattgtgttgtggtaagccactaagtttgtggaaatttgttacagaaacagtcggaaactagcattctgtcctggaaaatcacttgttcccaggacactgatctgtgatgaaataggtaggtctgaaacaggaaaccaaacaccgcatgttctcattcataagtgggagttgaacgatgagaacacatggacacagggaggggaacatcacacaccagggcctgtcaggggatggtgggctaggggcggaatagcattaggagaaatacctaatgtagatgacaggttgatgggtgtagcaaaccaccatggcatgtgtatacctatgtaacaaacctgcactttctgcacgtgtatcccagaacttaaaaaaaaagaaagaagaggaaaaataggtctgcggtgctgctccacagagagcggccaggaccccatttcatctgccaaaagaaaatgtatacgcagactcgtattgctggagtccattatgccttttaagaactatgcctcttaaacagtacggtgcttgtgggtaaatcatccctgccatttttcctattcaaacatgttctggtatctactaacacaactgtattaggtgtgtaaaaggcatctcttccctgagtctaagcagaagtgctacctcgcccccctacctcccatcaaatctgtggctgcataaattgactttataaagaaatcctgctttgcttaaacagctttggaaagctgtttaatatatttggccgtaattggttttgttttaccatctggtttagacttccccctcagccaactttaattttgaagttaatcatttttaaattgggctttgaatgcacctaggtcagatttgccacatcagaggagagtttatgtttgcattattctcaaaaagattcttcagttttgctttgttttttgcagtttatttccctatgtgagtttcatttaaaggaaattggtgcctatactaatagctgagtattcacatgtgtggaagactttccttggcattaaccattagataccatctgatgcagctgtcagtgacattggatgtgcatggggctgtggaattgaatgttgaccatagtattctgcatctagttagggaagtcaagcagtaattttgatctttctacttagtcaattgtttggccgaatacattgacttatttgggagagtagaactttttttggtggagaagaagttgtgtcgtgatggtatattttgagttaacctcaatcatgacaaaccagaatgatttcctagatgcacagagaaggaaaatgttaaagactctcaattgctttttaatatataatatgcaatatggaaatctgtcacgacacttgaaaagaaaacatttataagtgaggcctgcttcacagtaatgacaaaaacaatagacactaacataaataaataaatacataacaaaatatttgccaataaactcaagtttagatttcagtaattaggtttggaaatgcatctttgctactgagacacaaacccctaaaaacaaacagttcattggttgtatgaaatgctgagaaaaaaaatggtttcaaaaaatgctaatgctgtaataatttgaagagaataaaagtaggatcaagatcctctaaccaggatcaaattattgcctatccatttttctgaagggcaatcagacgatttttatgtaagataataaatctgtagaagtgaactgtttgtaattaaacatggcacatcatttcatgaccatttataaagtcaagtgcttgttaacaaaaccgattttcattgttattactttctttaaaattattttcatgtgagatgaattcttttcttgaaagtagtccagctttgggggcattctgaaatttaattatcctgggcttgaaaaaaagctacgttttgacttaccatgttttttgtttgtttgtttctagtgaactgaagaataattgaataatgagtttatagtaacaattttataatatgcatatctatcatagaacaggaactacagtagaatcattggtgcagtcttgatttcttaacttaaaactaaaattagggattgagtgcctcattcgaaaatagcagcatttaagtgaatgtagagttaacttataagaatgtgaacaatacaatatctttccaatatttaatgttatcatttgtcatatataaaaataattaaaacatctctttcctctcccagttttactttcaaagtttcagcaatagtcgattccctgcatacacaatttaccatgctgctaaaagcctttatacctaattttgcccacactgctctcgtgacccagagttccttttcatattcttaaccctcatccaccctgcaaactcagctcaagcaccacatctaaagagattccagaaggacaagcctccccatcaccaccatagatagcatcatatatatagcaaccctgtatgccccacagtatcctgcccatgcgtctacgaaaacacttcctgcattgcacggaatttgccaaatttgcttagagtccccagtgcttcatacagtgcatgaaacataataggcagccaataaatacccttttcatttataaacaagaatgtaaagtactgcttacttctcactagtggtttcttcaatagaccttaaagataccttctctagaaagcatttcattttccagcccctattaacgttagccaatttacttatacagtcaatttcatgttttgatttgaatgtatgttctcaaatggagccctaaagatatcagtacatttaattccatataaaaacaaataaaacagtgtttagcaattgacgttgggacataaacagatgaaaaaggcagttgtcatataccatagtaaccagaacttccataaacgagttaagacctttaaacgagaatacatttgaaatgatttatttctataaagtcttgcttagttgagtattcacataaatagtgacaatattgtgtaatcaatgggattttttgtttgtttgtttgttggtttttttgagatggagtcttgctctgtcacccaggctggagtgcagtggcgcaatcttggctcactgcaagctccgcctcccgggttcacgtgggatactatattctaacaagtgtatcgagaagtaacagttatgaacacacttgttttgaatgtgctgtaaataacaaaatggtaaaactgttttatttgaattaacacattattaaatgggttatgttccatctttactaaaacaaagcatgagattatgatgaaagagtaagcgtgtaagtcaccagttctatctcccactacttgttgacatttatgagatgagatttgtgccctgggtcctctatcattttttaacagaaaaagaaacaagtgtgaagaaggctagaaggcaaggattaaggatattaatcttagaattgtatggcaatagcaagctgtgagacctttggaaagctgtttaatatatttggccataattaagtgcatctctgaaggaactattaaaaacagatgctttaaaaaaatgttacaaccttgaacttttttgattctttttgggcttgaacatctaaaatagatgaggagaagttccttaaactgttttcttcaactcagtcattaaaacacatttattgagcttctactatatctcacgtgcagacccaggtcttatagcaataaccctcccccagaaatttagaatctaattggagagagagtaaaatagagataaaacaaaaccctgtgtcatgtacctattaatccaatatctcttggccttctgaaggatcagaaaacttaactccctgccttctttcaaacatgttcaaatcctccaactccagtaacatagatctcttttcttcactttttggcaaaatcaacagcctttttgcaaaccgtatctgtcacaaatggcctctcacagagagatttctagctagctcaatttacaacaaacattgccttccaaacggaatagcaggttttccaggaaattaggtaaaatagcaaggaccataacaaaacagtagtaattgtttaaatagtttaccacaatatttattttggatcagctacaaaagtaatgtcagaaacttcatttcagtttcttcagtctacaaatactaaaaatctgcataaacacagtatacctatttggccccactactaaaaaaaaaaaaaaaaaaaaaagagctagagccagacattagagagaatgtgtctggccaaaagacatcccaattgtttaaagacaatacatatgtgtgtgcttgtttgtttattggtgaataagaattatttaagtatatattgtgtgctttccaaggatctctgattggcagctatgattctccactgtaacttatgacaattctgtggcattaaaaagtactagggcagggtgtggtggctcacacttgtaattccagcactttgagaggctgaggctggtggatcactaggtcaggagatcaagaccatccaggctaacatggtgaaaccctgtctctactaaaaatacaaaaaattagctgggcctggtgacgcatgcctgtattcccagctacacgggaggctgaggcaggagaattgcttgaacccgggaggtggaggttacagtgggccaagatcgcgccactgcactccagcctgggtgacagagtgagactccatctaaaaaaaaaaaaaaaaaaaaaaaaagtgcgtgtttgtgcccaagtcctgactgtgtcacaaatgtgctatgtgaccttgagcactcttaatatcatggaattgccacaatttttagtttcttcatctgtaaaataaaggcattaaataaggagttctgtaatttttctagctctaaattttaccactccatttcagtggtttgaattttctttgaacccaggagaagtgaacagatgtggattttacaatttaaaaatttaaagcaacagaaaagcatacacacatgcatcatgacaatttcatagcagtgtgattttaacaggctgttaccttaaggtctgaaacaaaaataaaaagatcttcaaccatattcataggagtgaatataacattagatgtctaagactgtgtaaacaatcttcatggccaagaggctcaattataatgattctctcctgatatgtatttcatttgatgtgatacatatacaccatgaaaaactatgcagccataaaaagagtaaaatcatgtcctttgcagcaacatggatgcagctggaaggtattatcctaagtgaattcatgcagaaacagaaaaatatcacgttctcatttataattggaatctaaacagtgggtatacgtggacacaaagatagaaagagtagacactggggactccaagagtgggaggaggggcagagagacaagaggacatggttgaaaaactacctacggaaaactttatttattatttgggtgatgggttcaatagaagctcaaacctcagcattacacaatatacccatgtaacaatcttcacatgcataacttgaatctaaaattttgcttaaaaaggaaaaaatgtatatttcatttgagatttcccatcatctacagctcttataaattgcagtgatgtcagtggtctttgctgaagattttatgcgcataaattgtgttctcatagggagatttgacttcatatcttggctactgacatagaaacattttttatattatgcgcataaattgtgttctcatagggagatttgacttcatatcttggctactgacatagaaacattttttatatgtctaaatggcaaattgctcaatttaagcataaatcaacaaatgtatcaccaatatttcagcagacgctaattctttttcccgtatcatttaaaaagttattagatccgctggcttgatggggtcaattccagtttttaaaatcttggtccacgtgtctatgtgtctttggacagttctaggcatccagtgccccaaagtcatgggagacttaattcagcaaatcatatgctaattgaatgtcttccctggtgcagttcttccctggttactatttttacctttcctttttaagagttggggcaaaccttatggtatcttctgaatacaagtcaatattcaatggacgttttaaataagttaattgtatctaatgtgtgtgtagctcaatgtaaacattgccatatttatatctactataggagccaagggccctctcaaagctcactgaaaaatcaacttgcaaaaagcatattggagaaaaagcatacaaatgtatttaatgcatatacatgggagcctgtagaataaaggccaaagatacagaggaaattgtccatttttaatgtctacgttcaaccaagtgtggacagccatctagaaacatgattgaaggaaaaaagggcctgatctaatgctaatagatttagtggggaaacccaacaaggcctaagttcttcttggcctctctctacagcattccttctttcagggtatggaaggaccctctctggaatggaggttttatgacctacagtcaaacaatatacaatatatcaattgtatattgataatttcttatggccagtttttacacagaatggtggagggaaaattagagtgatgtttttaggttttatggctggctttggggaaaaggggttctggtttctatgacccactttggggaagagggattctagtttttatgactaaccttgggggataataggatctagacacaggagagcaggaaaagtacagagaaaatcttttgcttctgagactgccactgaggccttcatttgggatattgttttctgatccccaacatctgagcatcctagaaaataaaaatttatgcagtggctcattcctgtaatcccagcactttgggaggccaaggtgggctgatcgcctgaggtcgggagtttgagaccagcctggccaacatggtgatacccccgtctctactaaaaatacaaaaattagctgggcatggtggcgggtgcctgtaatcccagctactggggaggctgaggcaggagaatcacttgaaccccaggaggcagaggttgcagtgagccaagatcatgccattgctctccagcctgggtgacaagagtgaaactccatctcaaaaataataataataataatttactaattacacacttctgccttgggagaatatcttttatttaagttaatgtatcttatataggcttttagaagccatttgtgtctccttatttttcagaatactgattgcagcatgtttgatactttttaagcaaaatcacactgaaaataagacatttcaactgttcttcattagtgaatatttgggagagcagaatgcaatgatgcttatctaaggggatgtttcagtttgatttcagggctgtaaaaaatggtgaagccattaaaagagacatcccacttcaaatgatatagttatatttgtaaattgtcctattttgttaaacttaaaacagttctatatttaagtaactgtaactacttgtaggcattcggaagaataaaccttaaaataatttattgctttcatggtgattttattgaaaacgtcacttcctttaaatcatttcatcaattattctcataagaaaatacaatgtcagtgaaataaacagaaaatcaaataccacatgaactcacttataagttagagctaaatgacgggtacacatggacactcagagtgaaataatagatactagagcctccaaaatgttgcggggaggaagtattgaaaggtcacctgttgcgtacaatgctcaccatttgggcgacggatacattaaaagctcagacttcaccatatatggatgtgagacatctgcacttatacccactaaatacaaataagtaaatgactgacacgatattatattatccaataacaattactcatactagtaatttctttaagaaagaacagctgtggctgggcattgtggctacacctgttacccaatactctgggaggccaaggtgggagaattgctttaggccagaagtttgacaccagcctgggaaacatagtaagaatgtgtctctaaaaaaaattttaaaaatcagccaggcatggtgatgcatgcctgtagtcctagcttctcaggaggctgaagagggaggattgcttgagcccaggtgtttgaggttacagtatgctatgatcacagcactgcactccagcctgagcaacagaactcacatctgtaatcccagaactgtgggaggccaaggcgggaggatttcttgaggccaggagttcaaggccagcctgggcaacatagagaccccatctctacaaaaaaaaaatttaaaaatataattagttgggtgtagtggcacgtgcctatagtttcagctatataagaggctgaggcaggattgcttgaccctaggagtgtaaggcttcagtgagctatgattgaaccactacagtccagtctgagaaagaccctgtctcaaaaaaaagaaaacaaaatagaatacttacaaatttatggtgttttcattcttgtatagctttggtattcttgtatacttttgatattacttgtatattgattaacttgtgaaaatatatctttgcttaactattgggtttctccaagtttggtcttgcttttctaagtgttgtatctatatataaagccttcagtaattttgcaggtaacgggacttatgttaaatattgtcttttcttcatctataaatgaaatagcattctgatagatgagattatgtaaatcctttagtcagacgattagacttactgcataattatattttagacatgagatcatatagtagcctcaaattgtatgacagatttgagagaaaagggataaataatctaaaactcacttgaaagtcagcagcctgagacattctctgtttctgtgtacaaatatgttagaaaaatggttctgaaacactttgacattcctcactacttaaagattatgtaagaaagtagcaggatggaaactgccttattattttcttttttcttcttcttcttcttcttttttttttttccccccagacagagtgtcactctttcacccaggctggaatgcagtgacacaatctgagctcactgcaacctccgcctcctgggttcaagccattcgcaagcctcagcttcccaagtgcgccatcacgccaggctgatttttgtatttttagtagagatggggtttcaccatgttggacagattggtcttgaactcccaggctcaagtgatccacccacctcagcctcccaaagtgctggggttacaggcatgagctgccgtgacagccaaaaactgccctattttcacagtgaatacacaaaagagctataaaattaaaacatgaagctcctttgcagtaatcattaatggagcacaaaaccctcaagccagcctatgaaatgccagttcaattccgtgtccgttctgtaattcaggaaaaactctacaaaagtatcttacaaaggaagtattctgctttactaaatctttcctttaatgaaatactgatctgaaaacccctaattgaagtaggatgaaattcattcaaaaaatatcaagcatgtgccaggcactgtatgccagtgaacaaagatgcatgccttcactgcattttagcagagggagtaaaacaaagaaacggcagggcagagcaccaggatgtcaggctgcaattttttttttttttttttttttttttctgtgagacaaagtctcgctctgccgcccaggctggagtgcagtggcgcgatctcggctcactgcaagctccgcctcccgggttcaagcgattctcctgcctcagcctcccgagtagctgggactacaggcgcccgccaccacgcctggctaattttttgtgtttttagtggagacggggtttcatcgtgttagccaggatgatctcgatctcctgacctcgtgatccgccctcctcggcctcccaaagtgctgggattacaggcgtgagccactgagcccggcccaggctgcaattttaaacagagcgattagagcaggcctcattgggatggcatttgtgcacaaagtcaaaagtgatgaaaaaattatccatgaagttttgtgggagaaaagcattctaggcagacactagcagtcacaaagatcccatggccagctacactggaagaatagcaaagatggccgttgtggacaaggcagagtgagcaggaggaattcaataggaattgaatgaggtggggtggagtgcatgtaatttagggctccatagaccattgtaagctttcttttactcaggtaggaagccatctaaacaagacttagacttttaaaggatcagcctggttgctatgagagtagaataggttgggtgagaagagacacagatgaggcaaaataaacaccagccgggaaaccacagaaataatccaagcatgctatgatagtgtcttggatgagaataatagcagtagagatggtagctatggtagtgtcttggattagggtaatagcagtagagatggtagctatgatcgtgtcttggattagggtaatagcagtagagatggtagctatgatagtgtcttggatgagagtaatagcagtagagatggtagctacaatagcgtcttggattatggtaatagcagtagagatggtagctatgatagcgtcttggattagggtaatagcagtagagatggtagctatgatagtgtcttggattagggtaacagcagtagagatggtagctatgatagtgtcttggattggggtaatagcagtagagatggtaagattttaggtaagattagatgaaggatgtgaggagtccaagatcatttctgcctgaaaagccagaagaatggagtggccattaagtgattgaggacgactgagaagaaaaatttcagaggcaaaaatatgctttatttatttattttgaggtgtctagtagatacctaactgcagatgaggtggggtggagggcaggtaatttagaggttaatataatctgatgtccttataatgagatgagatcaccaagatgagtactaagagaggaggcaagcagcccaaggtcgagctcgggggcacaccgatgttttatcaaaattcagggaaatgaagattgagccggcagcaaaagacagactgagaaggagcagccagtaaaggagaaatgtcaagcaagtgtagaaatttgcaagccaactgaagagtgcttcaaggttaaatgctggctgctgattagatttaacaatgtggaaatctttggtgagttttactaggagtagaggagtggagacaaagcctaatcacctgtcagatgacctaaccaagtgtccaaacttaacagcctgaaaaagccataactgtatgatgcaatatggagaccatagcatcaccttgcactcttgcatacaaagtttaacctgaaacttaaaaaatttagacctttcagtttacaggaagttcaaagggatattagaagttaaattaatgacactacaaaggaaaactctacaagacaacaggcctagtatttccagaaagtgagaatcttaaatgaatcctgtttgggggatgagggtagctatttacaaaagagacacatggaaaaatctgaaataagaacttgatgttaaattagggaagtattttaagtggggcagtggtattgagaatattatatagaatcatgttcttagcagatgtatgtttaagtattgtcgtgtctacgactttccttgaaatatttcatgtaaagcaaatatgccaaaatattttaaaaaaagaaaagtggttctgacagccatttccaactattcaaactaattgatattcacttactcagaacttcttcaaccattacttcttgagaacctactcaatgccagacagtattctaggcaagggataaagtgtgttgaggaaacagacatgttccctactctcatggaaattacaggtcagtgaataagactgacaatgaacccgagaggtatagaactaaaaagtttgataaattaaagagaacaacaaatggtaatgtagatgaaggtggtgactacctcagattgggaagacagaggagaaacgtttgggaaattgcatttaagggaagaaccaaaaaatacagatctttttgtaaagattgaggaaaagagtgtatttgaaaaaaagaagcatgtgtgcaaaggcagcctcacacttttctgctcagtgttcagttgacacctgcccttgttttgcttcttcgtgggttatgctatagaagaggagcatgaggcagcagtggagaagcaggtagcagatcatgcaaaaacatacaagagctcatttcttcctaaatgaaaggagaatccattgaagtttttctttttttccttttttttttttttttttttttttttgagactgagtctcactcagttgcccaggctggagtgcagtggcatgatctcggctcactgcaacctttgcctcccaggttcatgcgattctcctgcgtaagcctcctgtgtagctgggattacaggcatgccccaccacgcctggctaatttttgtatttttagtagagatggggtttcacaacattggccaggctggtctcaaactcctgacttcaagtgattcaccgacctccacctcccaaagttctgggattacaggcgtgagccaccacactcagcccaacaacgatttttaaagtagcgtgacatgtgaaagatcagtctgccattttattgagaatgaattaaagcaaggcaagatttggaaggggcagtctagtcaagaagctgcaaaatggggtgggtggggttaggaggttgaactggagtggcagagacacagaaaagtggacagattggagccagtttccaaacttctgtttacaaagctttgttaatgattgatgcagaagtgaaaggaatgtgaagaatgacttctggtttcatggtgccatgaactgtgatgagggtgagcagaggagtagcaaaattagagaataacatccaaagatatgtttgatcatattcacccagcaatgcctctgatacctctaagtgattatatcaagaagcaggtggagtgtccaagtttcaggctctcaaagtctcaactagagatacaagtttagagccttcttagagaaagctaagggctgagccctaaggatgccagaactcagagttgaggcagttaaggaggggccaggaagaaacagggatcaactcagggcaataatgtgagttcaaatacgttcatagactgagaaaacggaggttgtgaatgcctgtgagaaaaggagcttttgtggacagatgagagtggatttcaggttggagttgactgaagtgttaagagcttgcttcagtgaatctttcaaggagtttgtctatgaaagggattagggaaattaggaactggagagggttatggggccgaaagggagagttttgtcatttgttttaggtaacattaatgaccacatattgagagaagtaatgcagaagaaaagttgataattctggaaaagtgtaagttgaatgggttgacaaagccagaggagataggacacagagctcatgcccacagagacgctcctttcaaatagcggcagcaccgggagagtttcctctgttctggttgtgtaattgtgtcgagggtccaattaccttcctgaatttttttttaatgtaagtaatttgttttaattgacaagataatgaatacctttggtttaatttatttttaataatacgaaagggaatatggtcaaatataagttttccctgcacctcaggtcctctccaaggaaaccactgtaacagcatccagtgtcttcctttcagaaatattctattcacagataagaatatttatgcctatgtagatagatagatatggatataggtgattctacatttctgtggtatcagtcacattctgaagaggacagaactgatccacttaaattcgggtgcggtggttcacacctgtaatcccagcactttgggaggccaaggcgggcagatcacctgaggtcaggagtttgagaccagcctgacaaacatggagaaaccctgtctctactaaaaattcaaaatcagccgggcgtggtggcacatgcctgtaatcccagctactagggaggctgaggcaggagaattacttgaaccttggaggcggaggttgtggtgagccgagatcgcaccactgcactgcagcctgggagacaagtacgaaactccgtctctaaaaaaaaataaataaaaataaaaaataaaaaataaagttttgtttttacaaatggttgaattacaagggataaagggacctacacagataatgcaggaatccagggctggcagctatagagctcacaccaccctgggcccaaggatatgatggggttgcagagattagagagctcagatgtgtttgagaactgaaatgagccacagttttttaaaaagtgtgacattcttggccgggcacggtggctcacgcctgtaatcccaacactttgggaggccaaggtgggcagatcacctgaggtcaaggagttcaagaccagcctggccaacatggtgaaaccccgtctctacttaaaatataaaaattagttgggcatctgtaatcccagctactcaggaggctgaggcaggagaactgcttgaacccaggaggtggaggttgcagtgagctgagatcgcaccattgcactccagcctggggaacaagagtgagattttgtctgaaaaaaaaaacaagaaaaacaagtgacattcttgtgacaaccaaaaacactgaaaataaaaacaaatcattataatatagtgtagcacagagcagacaagagaagtgactttcttactgaaggctgactgaggcagtctcacaagaaagaaccaggaaaatgcataacctgacctaaatcttctccccactctaatctgctgatagggtaagctcaatcaaggagaagtttaggatctctcagtgtactctgccttatggagctgagggcagggaggggaaagctgaagagtgattcttggaggggaaaatggagatttctgaccttcatgcatcaccacaatcaattcactattcacacaacagctagaacaatcgtcatttaaaacaaatggaagcatattataaacgctgttctgtccctcttgctttcttcccctggcaatatatttttgagattgtgtcttatcagtacacatagatctgcgttgtctttttaatggctgtcaggggttacattgtacagactcccttaatttattactaagtttctaaccaataaatatttttccctagattttttggctgacacaaacaatgatgcaataaacatttttaaatatgatttggggaaagtacactagtgcgtgtataagataaattcttagacatgaaatgactaggtctcaatatatgcacatttgaaattaatagactttatcaaattgttctccagtgtgcactctgatcaaaagtgcatgagaaggcttttcccattaaatatcagagagatgttcaatgaatctcattgaaatttaatttgggctgctttgattatgaatgatgttgaacattttctatatgtttaaaagttatgtgtttttttttctgtgaactgccctgttcaaaccctttactcatatttcaattatattgtttcttattagttcctgagtattcttcataggataaagaaaatggtcctttgtctaccatattaaaatatgcttaccaatttgtctttgtatttggctatgtttggtcactcaagatttaaaaaaaaaatatgtagtcaaatttattaatggttcctggatttgtgtcttcattagaaaggccctctatattagttgtttataaaaagtattccaccataccttattatgttttattgccacatacgtttaaatctttcatctatctggaatttattttggcaaaggaagaaggaggtctcactctttttctcacatgatagctgattgtcttacatcatttactaagtaaagcactttctccactgacttaacactgttaacctaatttgtataagtctttgtatttatttctggatttttaattctattctattgatctatctatattttaatacaccaatattagtttatatttactgtgggtctagtaaatattttatctactatcgataatcttacctgttaagctttaatttcagaatataatatccccgcctctgtttatttttattttttatttttatttatttatttatttattttgagacggagtctcgctctgtcacccaggctggagtgcagtggcacgatctcggctcactgcaatctcctcctcctgggttcacaccattctcctgcctcagcctcccgagtagctgggactacaggcgcccgccaccatgcccagctacttttttgtatttttagtagagatggggtttcaccgtgttaaccaggatggtctcaatctgctgacctcatgatccgcccacctcagcctcccaaagtgctgggattacaggtgtgagccaccgcgcccacctctgtttattttttatatcaattttagatttcatcatgactttttaagtttcccgttagtagtgtttgtggttatattctcccaacatctaggtaccttggatgtctttctcgcttcctctctctatctctcatcttccttctacctacatctcactatatactctctctcctagttcatggctacccataaacttttcctagtctgcccctgcagtgtgtaatcaaagatacaccaggttggtcaggcgcggtggctcacgcctgtaatcccagcactttgggaggccaaggctggtggatcacttgaagtcaggagttcgagaccagcctggccaacatggcaaaaatctgttttctactaaaaatacaaaaattagccaggtgtggtggcaggcacctgtaatcccagctactcaggaggctgagacaggagaatcacttgaacctaggaggcggaggttgcggtgagctgagatcatcccactgctctccggcctgggtgacagagcgagactctgtcatttaaaaaaaaaaaaaaaaaaaagatacagcaggttgtggtgaaataaaatgtatctatggacgtgaagcagataactcaaacttgatacttaaaacaagtatgttacatattcctgtgcatttcagaaaatttactttggggcacaatatttcttgtatctttttgttatcgtcatcttttttcctccagtaaaagagatgagatggaaataaggctaaatatttttttggggagaaatatagtttacaattattctaaatttaacccattttgagaaaacaaattatgaatttaaatttaaaatttacttttttaagagtttctatcaaaacctatcaggtttgaaacttccttgttatataagaaaaagtataacctcaaactgaaaatgccactgattatcactggtttctacacacagaatatctgaggcatcttaattaatttacctccaagtaatcaattaataatgtaacccctttaatccttttgggtttcttgtggtctcattctactccaggtttttaagattttctacttggagcattaaaatagctgttgagtttattttgcctttagtttttccctttcctgtctatcctgcacctattactaccttaatattttaaatatgtagttatcaagtaagttcatttttgaagactttcagtgctttccatgcctagtaaaaaatgttctaaatgccaaagctagttaaaaccattcaattaggggtgaagagaatatatctccgtggtgcatctcttgatggctggctttattttgcctctggataaagttcaaaaatcccttgaacagtgaatggactgtatatcatcacacaatctcccagaaatattgtttcctgctatttaacttcttgataagaaaccataatcaaatggcagagtttacaccgtaggtactcaataaatataagtcgaatgaacaaacaaagctacattctccaagaaaatccctaatgtaataattaatacattttgcaatctgaacccaacctatggttgtacatttaacatctatcagttcagttttttcagctgcatataacgcaacacataaatgacttaaataatagcagccaccaaatgtattatgtcataataagaaggcaagatataggtccacatcaaagtagaggaactgcagtcctattttagttaggatatgtatatttgttgtttttttctttttctttctttctttttttttgggtggtgggggagggagtttcgctctgttgcccaggctggggttcaatgacatgatctcggctcactgcaacctctgcctcccgggttcaagtgattctcctgcctcaccctcccaagtagctgggactacaggcacccaccaccacagccagctaatttttgtatttttattagagacgaggtttcaccatgttggtcaggctggtcttgaactcctgacctcaggtgatccatctgcctcggcctcccaaagtgctgtgattacaggtgtgagccacagtgcctggcctatttgttgttataataaagacccaaaataacagtggcttaaaacatccagaattatatttctctgtcatgaaaacctttgggtaggtggcccggggctagtatgctacccaaagctcagattacttagatattttcctttcattcactgaatgaaagttctcactatcacaggttcatttctggaagaagattgggaaggacaaaaaaggagaaatagttcatatccttcccctttaggagcttcatccagacattgcacatggcacttccattgccttcaacttagccacagggccatgtaacttaaagaaagcctggaaaatattgtctgtaactggtggggttctatgtcaagacataaattctattgctatagaagaggactgtaaattttgcataacaatgtgcaacagcttaatgactttgttaggatgcctgactctttccttcttgatccttggagactgaaatagtatccccttctaaaaggcacaggccacgtgaaggaggctagatacttgagcaagagcagggtgacgacaggaagaaaggggaaagggctgtggcatgggcatccacaactgtctgctgtgatcctcattcctgtgtgcagactttcttctctagctaaactcactgatttattacttcacaaccacattctgtgcttaactaaacatgcaggcccttgtcttccctccacgtagaaggggattcctcctccttccaggctactcaagtctaaactttctttcaaagatttgttattccataaaacttccatacacgcataaaacaatggcctatgatcttcattctgtaccagtttttctaatatctggcatatgtatatagaactcatttgctaattatgtttgcatgaataaagacaatttctttagaatgaaactttctttattctttgtttctcagagtttgttttagagtgtcttatgtggaacaggcgactgactgatttgaaagaacttagggttgtttatttaggtttaatacagttcaacctggagacagatgaatagacagatggttttgcaggttcttttcctgtgggccagcaatctttcaaaagacattttatttacaaaacagtgagaaatatattgtaaaagtataactctaagtaaattagcaaaatgagataaagtgaactctagttcattataataaaaaagatttaaaaggcagaaaacccaagttaagttgcttatctcatcatagcaaaattaatgattaatagatgtagaccaaatatgcttgctttttttttaatgaaaagtttgggcataatgtcagaggtacagtaaatatcttagcatttaaacatttctataaataaatgcttgttgaaggagctccatcaatattacaatagtgtttctagttttaccactataatgttatgtaataacaacattttaaattagttactggaattgtgattatttttctaaataatttctatttgaataaaataaatagaaggcaggataaaataaatagaagacactccatagagaatatcctttcaactgaaatcaaaatctagttagtatagaaataaaagtactcaaatattgttgagatcaacatagaaggtaatgcagaagaaaatactatgattatggaaacagctctgagagtcacgagtatgaaaaacagtattcaaggaagcaagaattctaaatatatttcttgtcttaataagcaaaaataaaatttcatgctgagatgaagggaacaactcataaattaaggaggcaatttatactggaataataacttataaattgttttaaataatgggccaatcatttacaaaaataagctatcagtaacctagaagcagtcttttctaaagtttagaacaaggcatatttaatgtccaggtgtaaagttggcattagtctaaaagcaaattaaatatcctagcactgttatatgtatgtggtctaagcatggggaaagtcttagctgaccctgagattgagaatgctgaacttgattttatgaagaagtgaaactgcctttatagtcagtgatcactttctatgaattatatgaagtctacagtcaggtgcagaaatgatttaacttgctaaatgagattacaaagattattatatgtcactctgagtagatcagattaaaacatggcaggaggacctatggaaaagcagtcttaggagaaatgactgaacagatcgtgttagccctggctgcaggctgtcttctctccttgtgctcccttcctgggctgtttctcctcctactcagcaactgcattctcctttgagcccccgctgcagagaagtgcgatgcgctagagccttgctattccaaccgtggttctctgcccgaccacatgagcatcacctgggaccttgttaggatctcagaatcccagactccaatcctgaccgcaagaatcagaatctttaagattttcaagagattcctatgcacacaaaggtttgagaaacactacttttgagtgccaaggattcggtttatacagaacagcagttattctgatacacacggcactgttcattgcgcttggtaccaccagaacatatttccatgtggatttctggagtcatggtgctatgactatggttttcatttcaggttttacaagaccaaatatggttttaaaggtaacacaaagacattttattttaaaatgtctattttaactttaagcactgtagataaaaagccttcaacgtgcgttgatgattaccaaggcatacagttatgctgtcaggctaacattttttagatttgaaataaaagttcttccactatccctgcttaattaaacaatgtccataaactaccaagtaagctactacaaacaaacaaatctggtaccatttgcagcttcttctatttgtgattcccaaaattcccaatgctttgcaattaaaatcaagttcagaaataaaagagatgctatgggtaaaataaaagtgcaactgtcatccacagccctggattgaattgcaacatccatctaaccagccactctgtccatgttgatttattttgctttaagtaattgcagcccatttgaccttccaaaatatagctttcatttgtcttatgtattggagtctaaatgaattttatttgaataaaatgcatttgattctaaagcattttgaaagctggaactaagtatgagttcgatggagaaggcagggctgtctggagcccgagttaattggatgcatcacttcttctggagtcacttgatcacaacaaattgacacctgccaacttctcccctgtaccttcctgatcccggtcaagtcattctcaagtagaagcagtcgagtcatttttattcatttttgatgtgaaccaaactttcaagctaggacttgccatgaaacaaattacacattccttgtggctactaaaaaaattagtttattagcgcaagagtctggatttgagaataaaatcatagatacaaataatctatatttctcacagtaaaagagatatttcttctgaaattacttgtttcttggtggtgtaacattctagcattgcattcatccattctttcagtcaatgtgtcaataggcagttactgagcatgcacctagttatgtaaagaattataagataaaaacccctaattgtaggaatctcagttcagaagagacaggtgctcaacaaaccattgctaagcaatgtaataatggtgtattggacataggttactagttctgtggaaatacagaagaaataataggaaaggggtagctaggttaattagtattttgttttgcttggtaactggtcctaacttttaaaatatatatatatggcgatagggtttgcaattatatttgaacaagttggttaggaaataaaacattttccaccattaagaattagaatacctataatcatcacagggagaatgtcaattttcaaaataagaatcaggcccgtgtggtggctcacgcctgtaatcccagcactttgggagtccgaggcaggtggatcacgaggtcaggagatcgagaccatgctggctaacacagtgaaaccccgtccctacaaaaaatacaaaaaaatattagccgggcgtggtggcgggtgcctgtggtcccagctgctcgggaggctgaggcaggagaatggcgtgaacccaggaggcagagcttgcagtgagccgagatcgcgccactgcactccagcctgggcgactgagcgagattccgtctcaataaataaataaataaataaataaataaataaataaataatcggccgggggctgtggctcatgcctgtaatcccagcactctgggaggctgaggtgggtgaatcacttgaggtccggagttcggcaccagcctgaccaacatggtgaaaccctgtctctaataaaaatacacaaattagctggatgtcgtggtacacacctgtaatcccagctacttgggtggctgaggcaggggaatcatttgaacccaggaggcggaggttgcagtgagccgagatggtgccactgcactccagcctgggtgactctgtctcaaaaataaatcagtaaataaattaataaataataaaaataagaattataagaaagaaaaatattaaaattgtatctaaataaaaaatacttttaaagaaatccttaatactgaatttttgaagtacagttggacctctgtatttgtgaatccatcagtggatccaaccaatggcaaatagaaaaaaattaaaaataatacgatgataaatctaagtaatctagagatgatttaaattatgtgggaggctgtgcataggttatatgcaaatactacaccattttataacagggacttgaaaatgcgtggatttgggtatctatggggtgggtggggattggtgtggaacaatcccctcacagatagagagggatgacttgtattcattaatctcacttgatggatatatcctttttgcatgcgtgtaagaacacagtaatcttttctatcatcgagatgattttctactctgcccattatttacaccacatttagattccagcctggttttcctctgctacttagtacccttctgcactacttcccccgaattaattgatataatgagctgatgtaaattactttcaatattaggctgagctaatattaacccgcaataatttagaaagtaaatataccatacaacaccatatacgtactgaattccaaaattaagtatcaaggatgttttagtttcatgtaattttgaagtgtctagcccattgcttccttccatcatatgcagaaccacctgctctggatgtaaacaccttctgctgtgtgtgttcccacgcctcagggcctgtacagaatagtggctataggaaaggaccctcacaaccctgcacctcccactgctttcactcttccacctccttatcagtgcttttctcgcctattctgctaggaatgattttcaacattttaatcataaacatacaactcttcttttcaggcccgggtgaaatgttctgaactttatgaagcctttgtttatcatccacttgtaactcctctagtatccaaatttctatagcatttcgtgtatcttttatgactcatcaaattcttctgggtttgcatttttcatgaatcagatccccaccccacctccactcaaatttggagatgaaacatctttgtagccttgataacactgagcccaaattttataaaaaagtaagtgtctattaaatttagggtgaattttccatccctcatgataattcaacaagatgcttttgtttatattgtatttttccccaatgttcttcctctcattttcttctcttgtagtcctgtccattcattgagtctcaacctaaaagcttttaattgtgcccaaaatgtacatgattcctcatgtgaaatcccgtagtactttatttgtccctgaattatgctgtttttcatttcttccttgcactgtagttttcatacatactgtatctacttctatatgaactatgagctcttctgcaaggctgtgaatacagtcgtagtcatcttctattttccgtagtgctgtgcatatagcaggtgctcaatcaatgtttgtttcaggagtaaaagtttgtaaaaagttgtggaagaacagcaagctactcagagccaggggctccatgccaaactgagccaagcccagctacaggtggttttaggcatggctagtggtaaattgagaacaggagttggagaatgctatttctgaggccagctctatcagattttgtagcagggagctgctagggcattatgataaaggggtggctctttatctgtcctttgccagtgacccatgattatagattctgctattttaatctgggaaagttttcctgtttttgagagttccctactaaagtctagatgtcctttgtgaatactggtacatcacaatgaatacctttgttatctgtgagcatcttcagcaggattataacaaaaatcaggttgtggggtagatggagacaggaattgatgggagggatgagtggatggaaccaggagaaagggtttgtgccattgaaacaggggtgtttcaggacaaatttcagcctcacaatttctgaggtacagtaaagctgtgccctggaggctgtgtttcagaaatctaaagcttccgtttattggcccactatttcctgcctattagttgtctgttaatacttcatgaacattatcctcaaaccttaaaattatttgtaagatagaattatcctatttttcaaaggtgaaaactaaggttcagaaaggttcagttaagtagctacaattagtcatcttaataaaaagatatagatttgaacacaaaacctgtatctttccttctgtattatgcttgctgcctctttcagcaggctgctttagttatccagtgggaaataggtgtttgggagacttagaaatcttttctttctaagttagtatattttcattgctgttatcatgacgttatttcaaaaactcaaattgctatgaaaaacttgatgatacccctctttacgtcagtttttggcttgacaaagaatagaataaaacaagaaataagacagcttatcttcgatctttcaccaggagggaacttagctgctgtctttgttttggggtaaaagaaaaataaaatgaatctgtgatattcaagtaaatccctcagttgtttgttagtgtctactgtttactcaaaaatgggaagctccaggtcggtgatacatcatctttgttgcgcttggcaccttctttcatgaatcatattaatctgcttaaactaacaaggattaattgccttggtaaggcaacctggcattgaaatgatatattgcccagacagcttggaatttggccactcataaatctcatttgtttgttggtttatttctgtttgtctctctctctgacagatgtgtgcccaatcactgtgagcatggtggaaagtgctcgcaaacatgggacagcttcaaatgcacttgtgatgagacaggatacagtggggccacctgccacaactgtgagtgccaatttatctcactttaatcttgtaattgcatgagaatctcaagtcttgagctgtgctttgaagctcagcaacctgaataatccacataatacatcactcgaatctgaaaaaccaagattccaattgtcatttctccaaaaaaaaaaaaataaaatacactattctacttgttaaaatatgttctctggtggcaaaggactcaaaaagaaggaccagcatttcctctgttccataaacacatagttgagattggaagtccaaacttggattcgcctctctgtgtctaacccacatctgttgggtcgattgtttgggaaatcgtgttagtgtgatgtctctgactggaccctcatttattaattaatccgagagggagacacagggtaattggaacatttagtttctggatgatggctgcctcatgctttagcccaactatttgactacctttttttagatcaaagaaatgagtccgaaatggaatatctaaaagccaatagataaaatacataagaaggtaataaaatgaagacataagagggtaaaaatattttaaaatggcaaaaataaaaagtaacatgcaaaaatgactaggaaaacacatatgtgccttggtttatataaatagctttattccaaaaggttaaataaaaaataaatttctgtacttaaaaaatttaatgctaactcttataattataatattaattttccaataatgcatcgccatttgcagaacgcttttgaaaacaaagcacttttgaaaacatatttggcatgaatcacataattacaagaagagagtcaactgttggttagtgtgtgcatacgtatgtgcctgtgtgtgtgtgtgtgtgtgtgtgtgtagggaaggaagagcaagagaaaaagagagattcaaccttctctcaatatgcccaaacactgaaactctaatatctaaatcctccgattatacaaacagatttcactttacttttaggaaatggtgacaagcaaactatctcagagtagagccctgtgtacagtaaaaatgtcatacagctctctaagcctttccattgtgttatttgtagtaatgtgcaagaagaaatcgtgttttgaatatattgtaaaatgttgacttacaaagttgcacacatttatttgtttaggtagatattcaaaaacaagaggcaaaggaaatcttgacaaaactaacaatagaaagatgtcaagaaggtcaaaattgatactagattcattatctgtgtttacatatatgaaagtattttaatgaataaagaacaaaaatgattgatactgaaattaattcaaagagttataactaaaattgttccttaccaatcacatcaaaatattaacctccagtatgtgacatttattaaatataacgtgatgctagaattacattgatgaaactcagtgccttcactccactagcataatttttatcgtgtgttataaataccatatttaattacacgggatcttgttcctgaaatacgataatgctaaccaatggtcaagagcaagaaatcggtggtggttgcaaggattttctatctcagtgatggcttttacattgaactgaaaagcaacttattctttttttataactgtttccatccttaaaatacacagcaaaaaggcaaaaaaaaaaattaaaatgtatgctactggttgagtagctgaggtttgttttgttttttaagggtaatgactccaaggattagaaatgtcctaagtgtgtttaggtttggtgctagtggccagctccaaaggtaaaagacaaaaattgtcttttgttctgctgctccttcctacttgttccttgctccattttgttggatctttaaaagcagaatcattctttttaataataaaagcctgatcttttgttgtcttctccaaatgaagccaaaattttgaatatccaacgtgtgcataaatagaggtgaaaagaccatactacataattcaagagagggttggctggtgactttttctttcgaaaaatatacattgtagcttattgaaggccatttgcctcctaataacctgaaagacttgatacagtcttacttatccaaatggattagttaaaaatttcacacagcacaaatgtaagaagatacaatgtatgccattcagtttgacacagaatgaacaattttacatttttgcgaaatcaatgaccacattcaaagcaagaagaacgaagtgcgaaggccccagtttctgatgtgtctgacgctagctataaaaccatcaggccgtgtgcctttgtggtcaatcatttgacttttcttgcactttgttcgactgaagtctcttggtattctacaagccagtgagctgagatttgcagttgcttattctgtattctgtgggtttgaactgtgtaagtaacataaaatattttgcttcattatttcctgcagaagaccaagcattcatcttgaaaagaaatcatgctaattattttaaatagtatttttttttaaaaaaagcagctaactaagagctaaagtttaatataatagaacatttgttagagtttcaaacattacaggctacaatattttagcacaccttctacactagcccgggcttggtcaggatgagacagcagtgctatgagtgacctgtgatcatccaggctagaagctctagttcaagatggaacagagaggcctttttgcttggtcactctgccttgtgttgactttgactttaccattttcttacttgtaccctaggccatttaaattatttgagcttcagttttctcctgtaggaatagataattaacagtgctcacctcttcaagccattgtgagattaaatgaaatgatgtacggaagatgctgagaaaaactttggcttatgtggtactcaataaatttttgtcatttcatcactttcagagcaattgtccttttcctttgaacttctataccaataattgcccaaatcacacaatgtgtctcttaatttaatgtcaccatacattgtttgctatcacttttatggcagatttggactgcagtgaatgactggtttccatagtatttttctccagaagaattgaagagtatgcctcctaaacctatgtctcctgttttcatttgttagtttgtgtgtacatggggactttgtttttacgtaaattatatgtagggcttagaggactgtcatttgtgaactgctcccctgaggagccaggatgtctccctttgggatgagtagacaactcaatcccacagacaaagccaaagatcacagaagatagtcagatcacaggaaagggaaagccagtttttgtcgtttaagaacaaaagaggcaagtttgttacaaaatgcaaatacattaaattgttgaagttttaaacttgaaaaaattttctcatacaggcattccactctccataaatcctttaagatctgaatagtagcatatctgaacaccaaaccatgacaaagggactaaaatgatcatgttgaacagtttgtgtttattgtattgacttatccctgcttcagtctcccaaaagcactgtaagaatgtatcttttgcttggagatggagtcttgctctgtcacccaggcttgagtgcagtggcatgatctcggttcactgcaacctccacctcccaggttcaagcgattctgctgcctcagcctcccaagtagctgggactacaggcacgtgccaccatgcccagctaattttttgtattttcagtataaatggggattcactgcgttagccaggatggtctggatctcctgacctcatgatctgcccgccttggcctcccaaagtgctgggattacaggcatgagccaccatgcctggccaaacattcttatatatactactagttccttgtgtggaactgctctaaaaattccttagaatatcctcaataatatgaaaacttttggctaatttaatgaatgcaagaggttaaaggatagtattttagtgttcgacaaaaataagcaatgttagccttggaaatttattaaatgtcagatgtgcattctgacagaaaatatttttgcagatctttttattaaaggagagattttcatgttgcccaaatatatagacgtaatgtttccaggggaaacaggaggaataaactagatgacctatataattctcttttaattttaaaatcacgagatttaaaaattctgaaatactagtaaggaacaggtcctgacattgccaaataaagcaaaagtaaaattttttctagccaatgttagagaaaaatttaaatgtaaacggtaacaattgtacattccgtatgctggagcatttcctctgggttcataaatgtgtaaactgtaaattgtgttgcaccttattacagcacacgtgagaggcgcagtggatttcaacagcccataccatgttgttgataatccatttcacctataattgatataattcaaagaataattttcaaaataaattgaattctatttgctgtagtcatactaacatagagcataaagacctagatttattggcacgaagaaacttggtgtctctgtccatttggagtttctacaacttaggcatcaatgataacttggagtttgagcattgctacaaaaacaagcagcattgggtagaattgcgttggatatggtattagtctgttctcacactgctataaagtaataccagagactggataatttagaaagaaaaggggtttgactcacagttccatgtagccggggaggcctcaggaaacttaccatcatggtggaaggcgaaggggaagcaaggcccttcttgacatggtggcaggagagagaattgcaagcgaagggggaagaaccccttataaaaccatcatctcgtgagaactcacccgctgtcatgagaatagcatggaggaacttcgcccatgatccaatcacctccctcccttggcatgtgggaattacaggtccctccctcaacacgtggggattacagttcaaggtgagatttgggtggggacacagagccaaaccatagcaggtatctaaaataaaatttagatatttagccttagggaattggaatccatcctttggggcaagttcacctggcttgccaggtcctacgtaatatggccatgtctttaacctgatttcctcccctacatctcctcccattctccccttcaatgcactggcctcctttcagtttttgatgcatgccctgcactctcatacccttgcccctcctataccacgaccccccaccacaggacatttgcacatctacctctctgctttgtctagtacatttctactcctccctcagatttcagctcagcagtcatctcagaaaagctttccatggccctgtagttagatcaaatcctcttattctaaaacacacatatgtcttttagcactagcaatggttatgattttgcacttattattcataatgatttaataatatctttctcctccactggtctctgcatctctggcaggaggtggtgccacatttcatccaccagtttaaatctgaggctcgcccagcacagactatgcacgcagtgaatatgcactgcctccaagcattcttgaatgtcaaagagtatccagagcaacagtgttttctttaaattttattcaatgccctctttacagtaaatttatgaagatagtgaagctataaggagagagtacacttacagggcaaaaagaaaaatagaatcaagtccaataacaaaatatgggtaaatggaaggcagggtactaaaaataataccaaaaactaccacaagacattaaacattattctaagaaattatatggaggaatttaggatattagcaaaaaaaatctacatatttcaaattatctttaaggaaaatattgtgccatgttaagatgccccattcattactgaaatttgtgagaactatgacattatagtaacaatagcaaaggaagttgcaacaaagataatatcttagatcagcactctccaacgtttttggcaccaggggccaggttcataggagacagtttttctacagaccagggtgggggaagtgggtaaggggatggttccagatgaaactgttccacctcagatcaccaggcattagttgaattctcataaggagtgcacaacctcgatccctcacatgcacagttcacaataggtttcaggatcctatgagaatctattgctgccgctgatctgacagaagacggagctcaggcgggaatgcctgcctcctgctgtgaggcccagttactaacgggttggggaccccttacatcatagagtgtggtcaattactatactggctaactataggagttattctaaaatagatacagatatgtttaaatattgactagtacatgacaagaagtttattttaaactctataaaatttgaataacatgaacataaaaatcttttgatttatcatgtaatattatatgtgtatccttgctacagggaagttatggagaggggaaaacactcagggtttgaaattagatgtcctgatgtcaaaccatcagatccttaggctatgtggccaaacttacttccccatcagttggacatgtctaagttccagaaaaatgactgtctccatactttataaattctctgtttcctcaaacacgcttgctgcattaagtgtggatttcactcatacttatagaaggtgaagtcagcttttccagtccatgccacaggttactgacagcaataaaataggaatgattcagatttaatcactttcctccccatctctccgcccccgctcctctgtgctatcttggttttgtgtttttagacacgtcatttaatgtctctaaacttaagtttccttttgaaaattcaatgagatattgtttattaaagtactttttaatgtaccccagaacttaaagtataataaaaaaaagtgctttttaaattcagaaaatgtcctacttttaaagaacttatgccactaagtttcgaaaaacagctagtcaaattttactttgagtgtaagtcgcatctactgatccgtatactcttcattcggtacacaggccatattttcatatcagtgattctcaatgaaaagaccataggatatctcagtatttcaataaatgctctttgaaaagataaaggtttttattagcaagtataatagccacactagctgatttatatgcatggagtacatctactctttctaatcgagatatggtattatctagtcaggttgtgcttctgtgttatcaagtgagcaactaccaaattccttcaatttactttccatcccattcccacaccatgatctgtgtcagatgctcagtgtgtccctgttattaaggagtgactatgggatccaactgcaggaccacaggacactaaggacccatagtgctaccatcacttattcattcatcaatatattgagagctgactccattccatacatggaatagatactggagtgtgaagtagagagggcaggaatactaggatgtagccccctccaaaaatgtgtatagtttcattaaaaataaaagttcttatcaccttatttccacatctctggttcaccaggattgtgatctaggaataaattctatgtattcttacctcttagaatctagcttggcatttttcacgcttacaaaatatggatacatgtagacacataggggaaaaaaatgatttaatactttgtcacaaattatttgttttaagcaattattttaacttttcagattgtatattcagaggatttgtttgctttatttctgggtttgtttttctaaccatatggacagggagaaatcagggtgaggtgatgcaacttcagcatggtgcttggtagagaatatggttttcaatagaatatatgcaagtcaaatgttaataagcccttgctcagctgtatgtattctctagaggaaaagctcgcattctcaccaggactaaagcattgggagctaagggaaataatggcaagtgatgtcacttcctgaaatcactttttgcacaaggaaacaatcatcccagcagctcctttactctcatattcatctggcacctacacagaaaataagatggaaagagctgtgaaagtactacctgggtagaaatgttggaaggggatttaaaggccattctatcttttggccacaaccaaataaattacactggattaaaatagtacaggtcatttggagaaacacagcccaaggacctctacatttctaaggcagaccaaattttgaattaatcccttcttgcttcggaatgatgaccaagattaaatatagaaagaaaggatttaatttcaattttgcaaagactctttcaatagtttcaaaaatatgtctttctctttgagtcttggcaaaaaaaaaaaaaaaaaagttgatctgcaaatgcatattgaaaagcagtgtgctgtaaagacatgctgtgatcctatgaacttctccgaagctataaaatgccagtgctaggtcttgagggaactggcattattcattaaactccctgtagtttgaatcccagtgtatgttttatccaaggttcagagtgaagagaaaaaggaatagaaaacacccattttaacacttttgtcaggttgaattaaggaaaaaaatgatatagggaaagagtctactttaatttgaagataaggaacggagcttcaggaaggttaatatctgctcagaaaacaggaaagagaattagagtaaaaaataatatgtgtctctcctttgatactttttaacttctctgaaaccaaactgtgtttggtttccattttgacattagttaataagtttctatgacaagtctttagcttttgaaacttggtgtacaggattatctttaaatcacagtttcaactcattcaacaatattatgcatctcttttgtatgtggcacactatgtgaatacaaaagcatagacgagagccattttccttatgaagtagacaaggtagttttaaaggaaagcaggataagtaataaaagcattaatacattataagaaggtaacatgtatttatgtgtccaactagtatcaaggcaagtgtgtatgatatgagagaaaaacaatatgaaccaagatatttgggaagacgttcaagcaggaacggaactctgagctaagttcctttcagagttctgtagagaaacagaactaattgttaaatattcaaaaaattttgaattgattgtttaaccttggtaaaccttggtagcttgaagcagaactttggtgtaaaccttggtagcttgaaccagaccacagtggaagaatttatgctagggaaattgacaaaccctgtaaagcaagatacttttaatagagctggtttactagcacaccactgccctgtttcattattaataaaacaagaataatagtatgtgcctgccaatattattgtgaagggttcagatgatttgtaaaatgtctaacatgttgtctactatgtagtcaattctcaacagatgacagccatggttataaatgtaatactgtgaagagactggtcttgttaaaggagcagcagggtgcagatttgaatcatgggtgaagctggcccagaagacagtggtttttcagcaccgctgtaacaaagcataacttcagatgctattcttcataagtcatttttttaaatcgtgaaacaacttatatccattagaacaggagtccccaatccccacaataccagtttgtggccttttaggaactgggccacatagcagaaggtgagcagtggtggagtgaagcttcacctctatttacagccactccccattgctcacatttccacctgagctccacttcctgtcagatcacgggcagcatcagattctcagaggagcacgaatgctattgtgaactgtgcatgcgagggatgtaggttgcatgttccttatgagaatctaatgcctgatgatctgccactgtttcccatcacccccatatgggaccacctagttgcaggaaaacaagctcagggctcccactgattttacattatggtgagttgtatgattatttcattattcatcacaatgtcataataatagaaataaattgcaaaataaatgtatgtacttgaatcatcctgaaaccatcccctacctcctgatccatggaaaaactgtcttccatgaaaccagtctctggtgccaaaaaggttggagaatgctgctttagaagaaagaaaggtcactgaatgatatttaagttttcccataacaggttatgggctctcagttatttctgaagtaaggagaactggtaaggctgctgaaaatgcttacagtgcatttttgaaaaccatttggatgatttgatatcacttctttaactattaacatttctttactgaaagtgatacagacgcttttattttactaaattacttctcaattatttagcttatagtatgatcttaggtaacaaagctaattttatattctcttgtgattattaacctaaatctggtataatgagatgcttcctcccctcaggagcggtccagctgtgactcagctgcatcaaatttatgtcttctgaaattaagacacctggatttgtttgctaaactctatttaaaaactactcagtgaggattctcttgattttgcaccattcacaggaagaaattctgaaagttgaattattggttcccgtattttttattttttatttttttttataaaatcatgataaacagaactcttacttcatccattttgttgttgctgttgccgcattttgctttttcttcctcctttcctctccctcttggcaaaagaatgctacaaaaatataaagattgttgtaatctggggcgaaattatccatccacctaaataatctcctcctgttatctttgatgaatatgtctaacaccattaataagcaatagtttcttataaaaaatgcagccgtttccaagaaaattttgatgcttgacttttggggtattctctcatctgacttctttcaaatgtttgtgaaatcgctgatttggaaatctttagacttagccaataaaagtgaaataatgtaaatggatatggatttgaataaagaatatggttttatttttaagtaaaatgagaaaaacattcaagggctcgtagtcccttagtttcatcacccagtttcatcccaaagctgccatagaagctcctgtctgaaaaatatgcctactctactcttgaaagcccattcttggcatcacggatgccaccaccaaatgccagacaatgttggcaactacagaattgctgtcatttctcattagcaggcatcaaaatgtcctaatactctctgccactatctgggcctgttgagatattaattaaacatgtctttcttgccaagtcatgtgatcaactttcactaggctaggtagagccaagtgagcccatccaactacactggataaagaaatacctctaagaatttgtctgtgaagaggaaaatgcctcccatttgtattactgcaaaggaattcagagctctagaaaagcctgtgtgtgttttctaccatatggctatctgttgctgagttatcccacttagagaatattcaagcatttgatggaaacatatccctactcagaaaatgagctcctctagagtttgaatgacatagatagagatttcctgagataataaaacctgcattggggcaggccagactgattgtcctacaggttcctaaattacctgaagctaggtggacagcacaaactttgttaatttattgtccaaaagcactatttttcttttgtatagttctttaaattaagctgacttaattaagctctgtgtaagagcaaaataacattttctggacttccacaagggagagattctcaataataaggattcctgccttcccacagcatagcagttccaggagagaagtactgggattgcatgcgtattagatgcccttgagtaaggcaagtaggaaactccagacagcagtacttgctgcttggttgttagtataggtgtctactcctgtgtgttacagcacctgatgggaaagcccaagctatgataaaaaaaaaaaaaaaaaaaatctcctctcttctcagctgaccatgtggctgattagccacaaggccagtcatcccaaagggtgctgaagagaagtgggctgggaggggaagcccagtgatggatgatgaaagtgcagtcattgcaaaacaagtccttctcttattgttgctagatccactgcttatgacctattttccgcttttaccagataaaatgtaccatcaactctgtcttgaaacttttgctttcctgcagtgtgattgccacagttccactgaacagaggtcattttcgctaagcttcctttctacagtctaaactaggtttttgagctaacacgtattttagaagtaaaaataatactacagaatgatgcatagggcaaaaatagtatagaggagaaatttattgagaagcatttggattgctattagtaatcaagaaaaatgtttattaataagtaacatttctcctcttcctttatacatatagatgagatattgaaagaagttgaacatagcagaagcatgttagtctaaagcccaagtaatctctttgctatttaaaaattctaaaggatttgaattaggatttcagttcacattcaaagtggtagttttttttcccatttgtcatcaccctatgcttctcatgcactacctaccttaagatgaaataaatgaatatcaggtagtaaattctaccacatgtggttattatccaaggaatgggctcacattgacacttgattaacatcagtttcacatgtggtaataaaaaaaaaattaatctgtgcaaactgtaattgtcatgctgggatcatttagattccagcagtctctctgttgagcagtttaagaaaactgtgttttcattgtactttttaaatgaggaagcccagtggaaaaatcatatttgaatcttgagaaatcttttgctttctaaaagtgcagtaaatgaatataactttgatggttgggaagatgagcttgttatccacagacttaaaaaattaagaataaatatacaagttttttggaggggtaatttagtagatattttaaaatacttaccagccaggcatggtggctctcgcctgtaatcccagcactttgggaggccgaggtgggtagatcatgaggtcaggagatcaagaccatcctgtctaacacatggtgaaaccccgtctctactaaaaataaaaaaaatagctgggcgtggtggcaggcgcctgtagtcccagctactcgggaggctgaggcaagagaatggcctgaacccgggaggcagagcttgcagtgagccaagatagtgccaccgcactccagcctgggcaacagtgcaaaactctgtctcaaaaaaaaaataccgatataatgatgtattaaggttagcaactatgcctaaaaaatgagtcctctgaaatgctaccttcttacacaggtctgcaaccaccccaatttcccaaattttaccctagttctctcccccaagcatgtggctacctactagttttaaccaaagaaggaaggctttaagcaggagggagaaagaatatggagacgttaggagagtgggtggggagaaaaggaggagagagctgcactcttcatctgtatataagatcatgttacttgcaaacagagacaagttacctctgaatggcaaggctgagaacactagtgtttctagctctgtgctttctacagtgtgatttgtggacaaatagagggctttatatgcattgcaagtgaccctgaagataatataaatgcagcttagaagaagtagaaatgtatctatttttaaagtaatcttacttcttaccttagatttaaatatatacttaaggtcaaaaagtatttttaaaatcaaaagaacagtatttttttccatgtaaaaccagagcaagatttttttttaaaaaaactggtagtaagcagaagtgatttcattaatgcctctttggaaacagtttatggataaaattagcaatatgatctatcactgacatttactcttttatcctttatgcagaagggcttttcatttataacaatgagagagattataaatcagttattaaaaccttatcaaagacaaaggcatagacatttttacattaaaattatgaatgcaaaaacagaccagcctggtctcttacaaaccatgaacagtataaacacattgacagttcttatactagatagatcctaaataaaaatgaaatcaaataatactcattcctggaggtatacctcatataagtccctttatgtcatcagcaaccctattgtattgacataagctctctatccactgttcttcttaatgccaccgaccaggtgcttttcatctttgaacacaaatgcctatcccactgcttagtgcttggtaagtattaaatacaatttggggcaactaaactgtaactgtgtctgaatgcacaaacacacacacatacccccaaatatatacacatacctctcaaatgactgtaaagataggttcatcagactcggaacatacaaagcccttgctacataagagaagctttctctgtgggatacagcatcttaaattcttttcaattctcaataagagagaagaactttattttcatttggtaatgttcctgatatatagtacatgatattctttatgccaagttttgttctatcaaaaaatatctgacacttccaaactcattttatgagtccagcattaccctgatactgaatccagactaggagactacaattaaaattacaagtcagtatccctgatgagcatacatgcaaaaatcttcaagaaaatagcagcaaaccaagttctacagcatattccaagaattatacaccaagatcaactgggatttatccctggatgcaaggatggtttgatatatctaaattagcaaatgtgattacaccgtataaacaaaatgaaggataagaatcatatgatcatttcaacagacacagaagaagcatttgacaaaattcaacatcctttcataataaaaactctcagcaaactagatacagaaggaacatacctcaattcaataaaggctgtatgtgaggagcccacagctatcatcatcctcaatggtgaaaaactgaacgctttccctcaaggatcaggaaaaagacaaggatccccactcctgtcacttctattcaacaatgcactgaaagtcgtaagcagagcaattgggtaagaagaagaaaaaaacacatccaaatccaaaaggaagaagttagattttctctgtttgcagatgacatgctcttatagagagatgtccctgacttcaggtggtttgacttacaactttttcaattttatagtggtgtgaagccaatgcaatttggtgtacttcaaattttagatcttttcctgaactagcaatatgtggttcatgagataattcacactgtattaaaaaatagactttctattagatgattttgcccaactatagggtaatgtaagtgttctgagcacatttaagtttggctaggttaagctatgatgtttgctatgttagatgtattagatacattttttacttttggtattttcaacttatcagtttatcagtatgtgaccccatggtaaatccaggagcatctacatatagaaaaccctacagactccaccaaaaaactattagaattaacaagcaaattcagtaaagtggcagtatacaaaatcatacaaaaatcagttttgtttctatacactaccaatgaactatctgaaagaaaaattgaaatcttcccacttgtaatagtatcaaaaagcataaattacttaggcatatatttaaccaaagaggtgagtgaaggatccatacattgataccatgaacatggatgaaaaaaagtgaagacgacacaaatagatggaaagataacccatgttctcagattggaagagtttaacagttagtcccactaaaatatccttatcaatgcaagctatacaatcaaggaatctctatcaaatttccaatcagatgttttatagaaatagaaaaaaaaatcctaaaattcatgtggaatcacaaaagaccccaaatggacaaagcaatagcaaaagaaagctggaggaatcacatactaagtgtgagggaaatgcatatcaaagtcatttgtgacaacatggctaaacctagacagcataatgctaagtgaaataagccagacagagaaaaacaaatgctgtatctatcacttatatagggaacctaaaaaaaaatgaaatgtcaaactcacagaaacagggagtaaaataatagtaaatgcagaagctgagggtagggacaatggagaaatgttgatcaaaaggtacaaactttcaattacaagatgaataagttctggggagctaatatacaacatggtgactacagttaattatactgtattgtatacttgaaatttgctaaaagagtagatctgaagtgttctcacacaaaaaagaatatctgagttgatgggtgtgttaattaacccgattgtggtaatcatttcacaatgtgtgtgtgtgtgtgtgtgtgtgtatatatatatatatataaaacaaatcatcatgttgtacattttaaatatatacaattttatttgtcatgtgtacctccatgagactgaaattaaaaaaagaaagtagcaggaaaagtaggcttcaatatcaacacaatggatttttggacattttgaggcaaggactctattatacacatcagaagagtgtagaaaagcaatagttgagcgagaagtaccctctgtgcttttcctgacagatgattccaaggcataggatgctaagggtgtttgatttctagggctgccattaataaataaccacattcttgctggtcaaaacaacagaaatttattctctcacagatttgcagtttagaagtccataatcaaggtgctggcaagcccacgctccccttgaaatttctaggaaagacttttctttgcctttcactggcttctattgattgccagtaatttttggcataccttgacttgtacatgcctcaatctattctctgcctccttcttcacacagccacgttccctgggtgtttctgtctctgtccctgtgtcagaatctttctctcctttctcttgtaaagacaccagccattggattgagtgtccacattgatccagtacaaattaatcttgacaaattacatctgcaaagactgtattcccaaatacgatcccatcatgagtttgggtggaagtgagcttttgcaggactctctacaccccgctttgccacacctgctcctgtccagcacggagctccctgtgtcccctgtgctttcccagctccgttatgccatcccctaacctgcaccccagattactcttctccccacttttaccacactcaaaatttactttctgtaggctccagtcacattctctttttattttgtgaaatcttgtttgctcactaaaacttaaacggatttctcttttgtaaaaaaaaaaaaatatttttgacagcaattagttctgtgtaatgtctctggtatttatacactcagttaattttttttccaagtgttttacccacagttttttctcccagaaaataaattgtgtaggcctaagttaactattctgtctctctttttgcaaaacctaatagtctttgttgattaaatttttcattttgaacacactctgtgggtttaaagaaccctgaggagaagggagaggagagtatgttaggtattgaattttcattcttcaaaattgcatgtaaggaagatattttatttttcagatgaaaaagctgaggttcaaagttcatggcagagccacaatttcaaaccatttcctgttgattttgtgaaatctgtgcttgtccatactccctcccttctgccatggcatttccaactctcagagcaccaattccaaacagcctggagactgggaagtggttctgagaagttggttttctattggcagctctagtagagaagccctgtcctgtagctcctgacatgagtccccagtgcatcagcctgagagcagctgctgtgggagtaagttcagggtacctctgagaaaagagggggccctcactgacctagaggcatgtatgaaaacctagggctcccaaggggtcttggcaatcatttattctagctacctcattttatggagacagtatataatcattaaaaatgttttagtccgggcacagtggctcacttcggtaatcccagcactttgggaggccgaggcgggaggatcacttgagcccaggacttcaagaccagcctcgccaacatggtgaaacctcatctctactaaaaatacaaaaattagctgggcgtggtgttacgtgcctgtaatcccaaatactcgggaggctaaggcaggagaatcacttgaacccgggaggcagaggttgcagtgacccgagattgcaccacggcttggggtcctgggcgacagaatgagattctgtcttaaaaaaaaaaaaacaaaaaacctctgagaaagaccatatttaaattacattaaattttggagttataatcacattaatataaattatatcgagattgtattttttgtttaaaaatataatttaaaaactatattcatatatatatatatatgaatcagaaagactcatttttccaggcattttgggttagggaaaatctgtcctttgcttccccgaccattttgaatgtgattaaatatgcacacacacatgcacacacacacgcatgcacacactgatgcaaactttagcaagtgacatgagggtgtcttttcacaggataacttttttcatttgattcctcattcataaaacactagtatgatatacatccccacatagattttccccgtttctataaaggatgaagattcaaatgctgcaaagctcactccgggcccctggctcagaaacagttctctcagcactctcctgacattattaatggccctgatgtacaaacccagaataaaatagaattaaaatccaaagttaatttcaagctccattagaaattaaaggtgttgggaaagaaatcaatatttgcccagtgcaaaatgactaaattcaaagcaattaattctattattttgtaacttctaaaaactataaaagaccttcaaacaataaaatgttgccatgcgcacacacatatacaatgtgtgactaaaaataatgagaatgatatccagcagcgacatgcaaaaatctcttttattattttatagccacactatgtagtgtacacactaaagtgtgtcttaaaatagagccaattattccataaaattcgtggctatttccagcaattatcagcacttagttgtaaatctgggagaatttaagggacagaaacaatgcaaaagagcgaggagattaatttaaatggaagaaatgtatctgttttcttaattttgctttctctttttccagcttctttttatgtaatgctatcgatcaccaaacaaatggccttaaacgctgtagttcccaacaggatgaagtatttcacaacctgtagagctgtaggttataatacacataaaactggcactcggtaaaagctttttcctgtcagaatcattgccatttcttccctgtagtgccttttggagaaagtctgagttaacaaatggatcttttccaggtgcagaaagatcagagtcaaatgggtttggatcagatcttgtaacgagaatgtgtcactctttccctccccttgtcaagaaggagtctcttaagaaccggctcaagcatcacttatcattacagcagactggggtgaacagttgtaaaagataatgatagaccaaaccagttcttagctaaggagatgtcatgagccttctgatgaaacctttctctctttgtgatagagatagtcaaaatgattaaggactactagcaacagaggaaggcatggccaggcactaggaccattctaagacccatcaatatgaggaaatggagccatcgttggccaaaggctcgggtccttcaagtttctaaaattttttgtttgtttgttctgtttgttttttgttcgagatggagttttgctcttgttgctcaggttacagtgcaatggcgcgatctcggctcactgcaacctccgcctcctgggttcaagcaattctcctgcttcagcctcctgagtagctgggattacaggcatgcaccaccatgcccggctaattttatatttttagtagagacaaggtttctccatgttggtcaggctggtgtcaaaatcccgacctcaggcaatccacctgcctcggcctcccaaaatgctgggattacaggcgtgagccaccacgcctggcccaagtttctagattttgacacgtccttccagtggctgctaatcaacccctggccctttgaaaagttgtatctttttaaattgatttctttcaaaattgtactaaatgtagttagttgcccggaaggtgtgacttgtttaacctaatgaatcaaagctgggctttagcagttgagccacctgggccactaacatctacccactgtctggttttccacactagctataacaaaaacacacttgttagaccaaattgattttctgctctctttacgtctccaaattactcagctgtttcttccttcctgtgatattttaaaaggtctggggttctagccccaactctgtcacttactgtgggtgtgagctgaggctagtgatttggcctccctgatcctcactcccctctcctgtcaaatgaaaatgattgtatttaccttgtaagttgttttcttaaaagaaaaaaataaaacaatttaaaatgcatgtgaagtggatgttcatgatcagacctattgtagactctccaaagtagcagctgtggacattaccatggatctccattttcctgggtttcccaggactgcacactctctccccgctctgcttccttcagacctactctccagagagcttctggtacctaatattagtgtttgtaggtgaccataagtcaagttagcaaatatgacatataggaaagtagataagaatgcaggggtatgaaaataaggtaaaaatggggagtaacatgtgtttaaaaattgttaatctttctcaacaacatttcttatggactcagctaagtaacccaaggaggttgtctctcttcacccgctcctccccacaccagtccacccttcaacccttcaacgtggctaccatcttctctatatcactggatcgactcttgtcagttacttctatattggcaaattgatgttaacttatataaatgggacatctatattttatagaagttgctttctctttctttctttttttttttttttttttttttttggagtctcgctctgtcacccaggctggagtgcagtagggcaatctcggctcactgcaagctccgcctcccaggttcacaccattctcctgcctcagcctcccgagtagctgggactacaggtgtctgccaccacgcgcggctaattttttgtattttttagtagagacggagtttcaccatgttagccaggatggttgatctcctgacctcgtgatcggcctgcctcgtcctcccaaagtgctgagattacaggcgtgagccaccgcgcctggccactttctctttcttatagtggtttttctttgttttctgtaactcagcagctcttcatttgggttcagtgtagttcaagcctctgcttctcagtatacttcctgggctttttctttagccttgtcctccagtagtggtgctctccagctgtgtcctcaggctttccttctcaacatatgcacttacccttactgtccctaaccatggcatcaattttcatttacatagtgattccttcatccatattgccactctagaacattttgctgggcccattaaatgtcctggtggacagtgaccagcacatagtagaaatgtaataaattattattgaatgaatgatgtctctagatcctagccattatatccctgcatcaagcttggcatattgaaaatcaacttattctttctgccccctgtcccccattccaaccagacttccttttcctcctgcatttcctataaaggaaaaacggtcctttagcaacccagccactgaagccagtaatctagccacatctaattggtcaccaagttcagcatcttccatctctggaatgccatttgtatcccatcttcctcttcaggtcatacttcaacacagatactccccatttctgaataacagcaaaaaccttgcaactcttgatttaagggccttcagtttatccttcacacatctgcaaaagtgagaatttgatgccatgacttatcaggtcttatcaggttaaatccggatattctttggctgtgtccccacccaaatctcatattgaattgtagctcccataatccctgcatgtcatgggagggacctgatgggagataattaaatcataggggcagattttcccgtgctgttctcagcatagggaatacgtctcatgagatctgatgattttttaaagggcagttcccctgcacactctctcttgcctgacactatgtaagacatgcctatgactccttcgccttctgccatgattgtgaggcctccgcagccatgtggaactgtgagtccattaaacctctttttctttataaattactcagtctcggatatttcttcatagcagtatgaaaatggacgaatacaaaaccctttaataaatctccaaagttgtaaatataaaatttgaataaactaatctcacaaaatatgcataatctagttcctgtctttgtatagtttaacctttacccagttcccactcagctgcaggcattctgagcatgctataatgctttgtacacgtctttgtatggaatgcaaactccctcttttacttaattatcattggcatgttcttcattactcagctcaagtctctttgattgcaggaaacattgtatcatcccaaatctgatttagggcccccactctctgttctcccacagcatgctgtgcagaccgtgtcatagaaagagcaatacagagttgtgggatatttgctttttgatgtcaaaaaatatcttattaacttctcataccaaaaaacaggacaggactgatgcaatagttattcaacaaatgcttgtcatataatgaatggaaattccatatatccagcctgacactcccgaaattacttactggtctgacttttttgcttgaaggaaagcagctggacttgggttaaactttcactcttctctttctctgtctcttcccttcattgtgctttttctttctaacctgtatcaaatgagagagaacctgatattagtcacatatttggaaattttttggtatcactgagatttggtccctctcactgtcttagcagttacactttaagctggcttacatatagttgtaaaaagaaagactaggttccccagttaaagaaacttcagggacagaaaagctctcttctgcttgtttccttgcttgtaaagttagtctttgatataaagtttaatccttttatgctgcctggaatgtgctcagaggttttctctgcagattgtttcatctggcagttaattcctgggtacttctgggaattgaaggaaagaggtttttgagttttagttactgaacttcgataccaccagtcaatccaacagttctatgtctgtatggttttttgctttgtttcctctaaatcggtgattcttaaattgtattttatttgatgggcacatgagtaagtcaatacaagtacagactcctgggcaccatcccttctgattcataaggtctataatagagtcatggaatctgaatttcactgggcttatgagaagattccagagcagaggattcgtgccagtgtgactagggaatctgttttctctcttagcctttctatctgatcagaagatgaaacctgtctggggttctgcgtattctaattctttctcttctttgacttcaagttccccagactctgagggctaaaacccagtatttagtggccttttacagagcaaattggctggccattccaccttatccttgccatgtaagccaccagccatgcagactttccattacctcatgatcaagagtttcagtctcttcaccctcaccaggacagaggacatagtcaaggagatccctgcagaatacactgacaaaggacttcagaaataaagggagtcccagttatgaggatagcagacaaggaaatatggtagagcttatgttctgaatcaatcatttcagattctttggtttttacattgaacatgtatttgtgattactacaaatggttccaaaaaaaaaaaattcccaaaaagtaaaagtacaaccaatgccatacaaaatagattaaaaaaatctccaaaagtttaatggttcataagtacactcataaattttgaattattattaattcataattcccaagtagtatgataactagtatgcactttacaaaaggcttggtaggttaatatatgacaaatattgcttggaaattttattttattacaacactcaatttctaaattttagatttcataagtaagtgctcctgtgatgggcctacaaccatatatatatatatatatataatgcttcctcatatatatatacatgaggaagctttagttactgaacttggataccaccagtcaatccaacagttctatgtctatatggttttttgctttgtttcctctaaatcagtgattcttaaattatattttatttgatgatctcatgagtaagtcaatacaagtacagactcctgggcaccatcccttctgattcataaggtctgattcatatatatatgtgaggaagcattatttcccactgttctgaagcagccaagtaagaattaagctattgtgtcggtgcatacagacaactgcagtcctttgcagtttttcgcccctctggctacctttattatgtcagtgacaaaaggtgatacatttagtacatcgtgaataccgacctttcacactctttgagcccctctagcactttttctttttgttctgatcttcatacactatttaagagtgttatcagcaccaagaattcatagagtaatgattccactatttaattcttcatttctttaaacaagtttttttcttcctcaagccgattttcttttttaatgaaaaagctaattatcctttaaaacaacattttttttttttgcattttgcaataaagctaggaagtaatttagtaactttctaatagtaagttaatgagttttatcccagatctagtatcgtggggcatattttttatgtgtacataatgtttctaaactaagcccagttaatattttcttttacatttatcagcaagaaagagagaaaggagactaaaaacagacccatagctccccaaagtgcttaacaggagtatttaatggcatccaatcatacttagtcgctgtgtagatagaaagctctttgcaacaaaacgacaaagatcagacaaaccactatagtagccaccagagaactttgtatttcttatgtccattctgggctgattgtccctaaataagagctaacctattttctctgactttacatgagcaaagaaaatgccttcaaagtgctttctatagcaggaggtacaggtgccaacgtaaacctagataaaagctgtttgtatatttatttgtttgcttgtttttatcacactcagtggcctcgtgatgcatgtaattaccttgaccaaagcataatagtagacagcattaccttggaagagtcttagtaagatacaaactggacacatttttgagagaagaaataataggagttgggtgaaaacatatacagcatgggatcccacctaatgcactttatatcctaaaatagggagctctccacactctcaccatcgccgtgcccacacatctcatacgtgcatgcactcatgtattactaattctgtggtgtcacagtgtccacactcccatttgcagacttgtccttttgagacagttttttggaaccagggagcacttttcttgatagagagaattctaaatttttttgcacaatcaaaatcttcagtactaaatattcacattagcaacataagaaaagtgtccatataaagactaattgtccatacaacagttcctaatgttacattttagttagatgatctacagtttaggtcacagatactcagacctattccagaatctagccatattcaactttcatacatcattttttctcataactaaagatcaaagtagtaggaaaattttcatgatattgcaaagagatttttaaaaatacattagcttaaagttatttatcattaggaacctaagttttattcttatttaaagaaccataaatagaatttaaatcaacatctatcaagatctgtctatcatatcaccttccagaagtcaacactgtaaaactcaaatatgcgtggcttttggacaacaattccatttttagaattgtatagcaagcaaataataagacagagttacaaagatttatgtatgcttttcatctcagcatagttttgaatgatgaaaaatgtgaaaatattttaacatcaatagttgtatggtaaaataaatgatctgatgacatgctaagaaacaattagagttagcaagcagagctatgttgtttgacagagaaaacataagaaacctactctatactaaacagaaaataaaactaaaatgaaaatacctggttgaaaatataaagaaagaaaaaaacataaagtgatatatcaattttaacagtgatattttccaagtaataagagtaggtcatttgaatattttttcatatttttaataaattgtttcagttgaaatcaaatgaaaatctattatttgtataataaatgatacatgtattttcatttaaaaatatttggtaaagagaaactaaagaggaataaaagaccagatgtttagttttactgtattttaaatctgtactcatatttgaaatacctatttgtttgtctaaatgcccgaatggattataatcttcttaaggcaagaggccgtggattgcccttttttttttccattgtacccctacaaaatagtagttgcatgataatgtattatgaataaatgtgtaggtggccttggtaaagccactttctctctttgaggctcatttttctcatctagaaaataaatacagggttctctactcacctcgctggggattgctgtaatgctaaaaggaggcaacacatgttgattataaagccttccatgtatgtgaaggaacattatttttaaccacagtaattacactcatagaaatcagtgaagcaagtgttggattcccatccccaggcttggctcaaggccaaatacaaaatcatgaagcaagccaaaaatacaggctgcacaagctgctcatctgtgcctgccttcctcactttagagacatagcctgccctcaggttccctgcaccttcctgctctatctctacctctcatgtaaaagtgtattcccattaaaatggaaccagagacgcatgcttcaatctgcacccgggggatatgcgttttcaccagagataagaaattatcagacaagaacaggatcagacctggatttttctgttttggaagacacacctgaaatcacacacccctccttcccctcatctgaaggccaaccaccaccacatggtcctttcaccagaggtagagagcactttgacactcagatctctgctggaaatgaaaacaccataaatctactcaagcaaatttcacccctctgtaagaaaaataacacatattattaaaagttatccttgtgttacatgaaaaaattagaaaaaaatacaatgacagtaggctttgctactatatccccataatcacagtcataatgtattaggtactaagaacaatacagaacaaccatattggtttattcagctgtttaattagatcacagttttttggatagatgaaggtataaaatatatatagatatggatattataaatcaatagatgtagatagatttttacatctattttaattttttttctgtttataaataagtaaaatcatgtattttatatatttaaatgtgtatgcattttaaataggtttcaatatttaaatattaccatctactttaaaagtctattatatatttgtttcttgtttttcaagctttttaacataagagcctgaaaactattctaatgaggacaaagtaacagaataaacctaggcacatgcccaagggaatgaagtttaatggactgtttagaaaagcatgaggttaattaggttaagattcttagaaagtgagatttgaactaaaaaaaaaaaataataaggtgttttgctgttggaaatgagaagatcataaaattcactaagaacttatccacagtgagtatagagaagagaatgggccatcctacccattgctgaggccaaaacccatcctggctgcctctctacactcacaacccacgtctaccccatcaactagttctgctctcaatgactctatcaccgccattctggttcaaacaccatcgtcctctgtctgtttttgcagtagcttcctgccttagtcgacctactttcacccaggccctattcactctcatcacagcagccagtgtgattctgttaaaatatgcattctggtcatgtccaacctcatgttaaaaacaacagcctccaaggccctgaactatacctcgatgatcttggcttctactgcccttccccttgtttgctcactcagttgctcacacattttaatcatactggatgtgttgctgtcccatgaacacatcgggcaagcattagattctcagggcatggcgtgtgctgttcttccaacttacctactgcatggcaagatccatcaactccatccagtcattgcccagatgtcatcttctcttgaagacccaccttaacaaccatatttaaaatagtaacctcacttctgttttccttatctcccttatctgctttatttttcttcatagttcattatattctttttttgtttgtttgttttgagacaagtctcgctctgtcgcccaggctggagtgcagtggtgtgatctcggctcactgcaacctccacctcctgggttcaagcgatcctcctgcctcagcctcccaagtagctgggactacaggcttgtgataccatgcccagctaatttttgtatttttagtggagatggggttttaccatgttggccaggatggtctcgatctcttgacctcgtgatctgcccacctcggcctcccaaagtgctgggattacaggcgtgaaccactgtatgcagcccattatattctaatatactgcatcttttgcttatttgtgtgctatatcacctgtctcccgcaattagaatgttaattacatgagttcagggacttttacctgtctattatgtttataattgtctccccatctaaaatagtgtccagaacattagtaggtacacaataaatattttttggattaactacattcatttatttgtgctgggaacagcaacaaaactagtctgaagagaaggggctgaaattagacctacaaaagcctgattcagtagatttttcagttggaaaatattgagtgcttacattaagatagttatggtatgatatactgatactgaaatgaaaggtaaaaaccaaagtaaaatttaagtatagatcttaaaatgaatagccccaaaccatttcttactggaaaatttaagtctgactctattgctgctattatagcagagataagagacttacaaaatctagatgaattaacaaaagattaaaatcatttaaaatgttaggagaaaacttaataaaactcttataatgtgattgccaaaaaatgcacaaatatttccaggaagtgttaaaagttgtctattgctaattatatatttgtacttttttttacagctactcatgtgtagaacaaaaaaatagacaaaattactcaggctcaatgattcactatgtacagtttacaaattaattagcttctcttaattttttcaattaaaaaagtgttaaagcattagtttattgcttatttccgtgttaaaatgctggttaattgcaaaacattattaggggccaatattaaaattccacttacaagtgtcagagaagcaaaacacatttaaagttcatttgcaaatccagcttacctaaatctacttgggataaagcaatactgctgaagtacgtaaccacattctgatgatgtatgtgcaatagtttttcccattagcttactaatgtatgtgtatgagacagagagagagagaatgtgtgtgtgtgtgtgtgtgtgtgtgttactaggattagctctagtttttaacatcataacagaatatgaagcacgatgcacaaaaattcatttataatttataaacactgagcttttaatttcaggtgtttcttctttctagttctctatgtcaatcatatagctagatacaacccagaagcaactctcattcagaaaaccacaaaatgtaattaatttctttcttttcttttttttttttttttttgcgtgtgtgtgtgtgtgacataatctcgctctgtgcccaggatgcagtgcagtggcgcaatctcggctcactgcgaccactgcctcccggattcaagcgattcccctgcctcagcctcctgaatagctgggattgcaggcacccaccaccacacccagctaatttttttttttttgtatttttagtagagaccaggtttcaccatgttgggcaggctggtctccaactcctgacctcaagtgatcttccctccatgacctcccaaggtactaggattacaggcgtcagccaccatgccccaccaagatgtaatgaattcgattaagatttggaatcagtcttgctgagatattcaagaggaaaattgtgaaatgggatctgatgctattcacaaagagttcttcttaatgcttcagaggcagctctgactgttagggttagggtcttatatggcaagtacgaatactcctactcttaaatcttcaatacagcaggcagggagaacttccttgttgaatttttcaccatgtgctaaaaggatggggtgaacttggaaagaaacatccgaacgtcaacttcattacaaacagcaaattgagcagctgtgggagagaaagttcaattgggacataaaagatccattcactgatttcagaaaagctatttctgaaaatgcacaataagtatatagcactggagtagcaaaataagtgtaagtcaactatagaaagctatgataaacaagaggaacaataaacaggacctaagattcattcgcacatatgtaaataagactacagcacaaagtaagggatactctgtcagcattatttggcattggttgttgtttttgttcaaatgtttaatccatgtcccagaaacttaagatttcaagtccttaaaagggacttttaaaaagtctcaagtaacaatgaatggaattaacagttttttagccagtcattttagtgtcttaaaaatagaaaaatatttttatgaagataaaaagaataagaaccatccattgcgtcaccatctagaaataagcactgttgtttttctttttgtttcctttttcttttgagacagaaactcaatctattgtcccaggttggagtgcagtggcgtgatcatggctcactgcaacctctgcctcctgggctcgagtgatcctcccacctcaccgtgtctgttttgtttaagagtatatagttatcaatccttaaagccgaatttcattcttggtagttactgttaaaattaagcatgaacaattgaaagattttacaaagtatatctatcatatacctgcggtgtatcatccttggagaagaaatgaacatacactgaacatagaaacaactaaactttctagataaatggaactaagagactaacttctgtttcaaatgatgacgaatttcagaaagagaaaaaattaagtagaaaaaaaaggagaatgtgagagactggggagagaaaaaataaatgagagaaggtggtagaccactaggatgaagaagcagaagatgaaggagacaggcaagatgctgacctcttagctcagtcaaggtctggactttgggggcctgtcctagcatcatctcttgcagtctagcacatgtacatacagatgctatgagaacatatgtctgtcaaaggccagtgtttttctagatcagaaacattttgtagctcttccggtggacagagttggatcatgtgttctctcaagtatttttatagatttcagaaacactgaaataatcagcactgaacgaatgtagccaggcttgtttctaaccctggattctgtgctttgattttgctatcacgcccctcactgtcaaccaccctgaaaagagaccttataaaaaattatggctgggcgtggtggctcacgcctgtaatcccagcactttgggagggcaaggcgggcggatcacctgaggtcaggagttctagaccagcctggccaacatagtgaaaccccgtctctactaaaaatacaaaaattagcagggagtggtggcgggcgcctgtagttccagatactcgggaggctgaggcaggagaatcgcttgaacccgggaggcggaggttgcagtgagccgagatagcgccactgcactccagcctggcgacagactctgtctcaaaaaaaaaaaaaaaaaaaaaaattatgctgcagtttcctagggctgctctaacaaattatcacaaatgttgtagctgaaaacaacacaaatatgttatcttacagtttgggaggtcagaagtctgaaacgggtctcactaggttaaaatcaacaggaacgcattcctctgggaggctctgagacaatctggtccattctttttcagcttctggaggcctcccgcattcctgggcttagggcactggccgtcatcttcaaagccagcgatgactgatgtaatctttctcacatcgcattgctctggcactgactaccctgcctttctctttcacttgttaagatccttgtgtttctattgggcccatctaaaaaatctaaaataatctcctacctcaagatccttaacctaatcacatctgcaaaatcccttttgtcatataaagtaatttatccacaggtttaagggatagggcagcaacatcttgggaagtcattattctgcctacctcaaacctcaaattgtattctgtgattatttttcaaaggaataaacttggccaggcacagtggctcatgcctgtaatgccagcactttgggaggccaaggtgggcggattgcttgaggtcaggagttggagaccagcctggccaacggggtgcaaccccatctcaactaaacaaaaatataaaaattagctggacatggtggtgtgcctgtcatcccagctactggggaggatgaggcaggagagttgctggaacccaggagacagaggttgcagtgagccacagtcgtaccactgcactccaacctgggcaacagagtgagactccatctcaaacaaaaaagaataaattcataaaatcaaatatttttttactgtgtgatagaagcagaaattagaaagcattatgaccacccacgaatcataaaatctttagtaggaccagtaggttaacatttttcctgttggagggagcgtttctttgatatataaactttcaaggagtcattgaaagctttggaaggcttctttccaaaaataatcttttagaaaaagtctttccaaagaatccagtcgttgtattttgggcaaaatattagaagtatgagaagccagagtgtgaaaactgagttaatattcttatgaacacgaatacttggcagccaatattgaggctgaaaatgcatttagaatgttaatgtatttccatagtatttcagatcaaagatactgaagggaacttaactgcaaattaaaaatagagaatctacaggaataagttacatttcttatagcttcctgtgcaatatcaaatcaagtagagcaagaggtggttcctactttacataatttttctcagaaggatgattttgtttactaccattgccctgtaagtattatgctttcaaggaagctctaacaactggttatcgctgaggttagtgtctctcatggtactcgcttcatgctctgtccattaggtaaatgacatgcaaagatggcttcctctaagtttctgagacacaggtactcatatttaacttccgtggaggaggaacacaggagtgaaatagaaaggtctgcatttggtgtctgtcttcccatccattcctaagagaagatgacataggcctactgcttatcaagagcatttgaccctaatgagtgtcgttatagaaaagttagaacctttctataagactttgtattttactttccagaaaattccaattcactaaactgtccatttcttctcctactagtgtgttattttcagggtgttttcttcctattatagtctcagaaggcccatgctcagcttccgtagaccctgtcctctgtcagtcagtcacttcatttacccctaggttttgactcttcacagatttctggatatctccctccaaagggatagctcttctgttgctaatgactagcatgagggttggtaagtagtgacagtaaaattaacattccttgaccacatgaatgtgagcaacgctttggatcagacacctgatctctgccacaccttccagattaagtcaaaaatgcctatcttggtattcagggtccacccaatctgcctttcctggctaattttccatgtctctcctatgttaaccctgcattccaaccaaatggtctgtttcccattcctggaatccctaggataaattccattaatttgcctgcttcggtgtagttgttcatgccattctccttcctctattgatcatagttccactataattttgttgtaattatcgggaaccaaagaagcatgaccctttcttctcatacaaggtttggatcaatttagaaataagatgcctagtagaaaaaagctggccatcaaaatgtctgctttattacaataaaagcttatttgaaagcagtgcttagatctacctacagtctaggcatactgctaatattactgtctatgcaaaaactgaaatcccattccgtggaagtctcccctggcaaaggaagagcctgccccaaggtgtttcccatgtggaagatgcgagaatattgctcctaggcagcctgaaatggagaatataagctgctctgatcaggtattgtttcttcttctaaattcacaaaatagacgagtcattctctgcctgtcttcactcgccaggatcagtgattttgaaggtgggggtcagggtgggagtagaggaatatagagagaggcccaaagtcaccttggctaaagtccctctgtgtggaaacatgagaccaggcgcttttatgaggctttcttgaatatgcttatctgtgaaacataatgttttcccctttgtgctcccaggtttgtaggttatatccctcatgcagaactgagagagtggttcagctaccaaataccatctgttagtctgttccagctactgtaaccaaatgccataaactgcatggcttataaataacagaaccttatttctgacagttctagaagctgggaagtccaagatcaaggtgctggcagattctgatgagggtcccctactttctggttcatagatggcactctctcacaagtgtgctcatgtagcagaaggggcacaaggagtatctctgaggcctcttttatgagggcactaattccacctgtgagggctctgccctcatggcctaatcacctcccacagttccccacctcttaccaccagcttaggggattaggatttcaacatatgaacttggaggacacacgaatattctgaccatagcatatacttactggttttttatttctgattttaattggtgcttaaaggaatatctaggtattcctaataactattatccaaaccttccaccaatattttcaataaatgcctggggaacagaaaatgaatgaattaaagtatctaccaataatattttagaaaaaaaacctaaaatttgcaccttcctttttattcacaatatgattttcatatgtaatatttagaattattaccaaaagttgtagcagagcctataaattaaaaaaaaatttcaagggagcatattagaattaagcagtaaaatggtagaaacaaatggcttggtgggataaggagcagtaaacatttttttgcatattctccagttttacaaatttgccatcttcacattttgggggaaaaaagtttgaaagaatgcctttttaaatccattgagaaacatggatagctgatgctgtgcccatactcaaacttcaaaattttctggcccagcaaaaaaaaaacaaaaaaacaaaaaaaaaaaaacctactaaaaaataatagtttattgaagacaagaaaaaaatattactctgccttattcatatgcctgggaatacaatatatttgaaatgtattatttctaaatgaataacaaacttgtaaaccaacacaatcaaatgaattcattttcatactagttatgtgttacagagcaacaaattactccagattgtagtagcctaaagcaagaaactcattatttcacagtgtctgtgggtcaagatttcaggcacagcttagctgagtgcctgtggcctgggtctctcacagtcaagatgcaatcaagatgctgatgtcagtgagggccgcactgatcataaggcccaagagggtaaagatccacttccaaaatcattcaaatgctgctggcaagtctcagctctttgctagtcatcgactgggcacatctgttctttctcatggagcctcgtcatggggctgaccacatggcatcccggttcaccaagagggagagttctgacacagagagaggagacagcgagagagagaatgaatgcacaaaacagaagccacagtcttgtaatagtctaatcatggaaatgacatttcatcacttcaccgtattgtattctttggaagcaagtcactaggtccagcgagtctcagagggaggggattatacaaaggcatgaataccaggagttggggatcctttgggatcaccgtagaagctttcctacatatccttctttcctaccttgtctggataagttctgtctgttcctggagacagctgaagaatttcctcttccaggaagctccctccacacagctgagcctcctcctctctgcttctgcagcagcttgggccccctgtatcagggcatcctgaactgcacaggtgccttgtgagcacctgtctccttgcgtgtctccctcttcgggctcttattcctcaacagccaggttcctgtcttactcaattcccatgcctagttcacagcacagaccgtgtgctatgtacagatgtctcgtatggagctataaattataattgaacataacagaatttcattcacgttacctgcagaaaataaatactgcggtgaatctcactcacttgcccctaatactcctctgcaatatttaagcacggaggtcaaacagtttcctccgtttgggaacttgatatttaatgaaacattttatgagtccgttgacattgcttacctcagctgcagttccacagatgacttcggaatgtgtgaaatagatctcttattcttcactgataaaacttcgggtcagactctcacacaactgcacacatggtagctttgctccactcacaccttgtctacagcctagatgtttgcaaatagtgctttggtttttctttaaaatatccttttgctattactatatatgcccactgctttgttcagttgaaaaatagcgtggctagccgggcatggtggtgcctgcctgtaatcccagctactcgggtggctgaggcaggacaattgcttgaacccgggaggcggaggttgcggtgagccgagatcacaccattgcactccagcctgggcaacaagagtgaaactccatctcaacaacaacaacaaaaaagcgtggctctgttatgccctggcactgtgctaggtccccaacattcacagaagactaaaatataatttctaatgtgggagacaaaggtttataagccaaagagacacaactcatcagctggattttgcactgtgacaagaactgacttagaggagcgtggctgtcttctaattcagggactctggagggatgtgtaactaaggttcaggtcagcacacccaatgcaacatgcatactctgtgcagaaagtaaattgaaaactctgcttgagggtctcagtggacctcaaagcagccctgacattttcttgtaagttagtgcagcataggagttccaattctgcgttcatcctccacagtgagtccccaggagagggaccagagaatggagtaaaaacaaagggaagggagagaaaccacagctctagtggtcacaatgacaccaggaccagtagaagcctgagtcatacaataatttctactggttcagtttctactgaataatttccaccattaaaaatgactccaagcacttacacatgggtgaaacctagaaagtgaaacaattgcttgttatatcttgttagcaggcaaagaaaggatggtgaaatcagctgttggtgaaattctgacagcagggaaagtcgggggctggcatttctggcaggcatgagagccacaaacgggtgacagaatatctcaagagacaatctagccttattcttaatttttgcttaacatatttgttttgacataacattctcatacatctttaagttgagaatcagaaacatgtctttgttataataatattgttgatgtcaaagaaacacagagcatatgctgtcttaggaattctaaatggcaaatgacatgtgtgtctgtataacaaagacaaggagagatagagacaaatataaggagagaaatgcaaaccaactctcaaagtccttaaatcatattataagtgggcaaagacaaggaaagacagaaatagagacaaatataaggaaagcaatgcaaaccaacactccaagcccttaaatcatattctaagtggataaaatgtcacatgtgaaagaagtgagataccagatacttgtgggaactaaaaatggttgggcgtgtccagagcatataaagaatgggcagcagatatagttggatgggtaggcagaagctagtgataaaatattggatatcttaaaccaagtccttgaactttattctggaagattgtgatttaatggatttaatggggctgtacgtcttaacataagaagggaagattatgttaagaagccatacatagggaaaaaataaattctctcggatcaagttacttcagtaaacatatttactaactgtattaatattatgactctttcatattccgatatgttgtttcctaaatttattttccaacagaaactttttcttggggagcatgggtttcaggatctcaaggagccagtagtccaattgttttagaaaatattgttaggctgggtgcagtggctcacatctgtaatcccagcacttcggaaggttgaggcaggcagatcacttgaggtcaggagtttgacaccagcctgtccaacatggtgaaaccccatctgtactaaaatacaaaaattagccaggtgtggtggtgtgtgcctgtaatcccagctactcgagaggctgaggcaggagcattgcttgaacatgggaggaggaggttgaagtgagccgagatcaccccactgcactccagcctgggagacagagtgagactccatctcaaaaaaaaaaaaaaaaaggaaaagaaaatattgttgtggaaaaacattgcaggaatgcttgaatctttggcatttttaaaaaatctaattcacagtgtgactttgggacaaataagttcatttgtttgggctttctcttgtggactaaggaggtagaagaaaattaagcagtttctgggatcccttctggcagtatattctcctagtctatggaaaatatgctataatcagcctgtctggaatatagatatcaagctcgaggtaaagttttactcgtgaggattaaatcagtgagaagtagcatatttaagaaaaaaatatacaatcaacttgagcactctaataatggtttagtgctcattgcttgaaggaataatttttgacaaggtcctgattttaaaggctaatgttcattttttgcctcgaccataagtaagagctagaacctgtagtatataggtcaacagattctaaaatatatttcagtatgtgctcaccaaatcaattagattttttaagtgaaaatgaaaacctctttgagttcagtcctaggctagctggtaaagatggaggaatcatgtgctcatgactagtcctcttccaccggtatgtcaagtattaagagaaagaagaaagacgtttccaaataacttgggatttggggactttggcttaatttgtacttgtatttgtttccttagactataagccacggattaagtttttctgtcattaaggcaccattaactattagaacaggttaacattaaccaatagaacaggtatacctttgatttccatgaattatggaagacaggcatttctttttttttttttttttttttttttttgatggagtctttctctgtcacctgggctggagtgcagtggtgtgatctcggctcactgcaagctccatctcctgggttcacaccattcttctgcctcagcctcccaagtagctgggactacaggtgcccaccaccatgtatggctaattttcttgtatttttagtagagacagggtttcactgtgttagccaggatggtctcgatctcctgaccttgtgatccgcccacctcggcctcccacagtgctgggattacaggcgtgagcaactgtgcccggccaagacaggtatttcttttcatattttataaattagaaaaccaaggtttagaaatcttagagagcatacccaaggtcctaaaaagtgaaaagctgcaaaattggaaatgcagcttaagtcctctcagtatgcgcagcgttatacctcattttctaaaagatagcatttctcaagaaaatgtatacatactgtatgaaagtccctgtaaataatgcaaatgcttgttgaatttttaaaatgtattctgaaactcttgtcaaaataatagttagtttttaccaagtagcatcagtagccacattacatagcagaatttaaattataatggcttgaatcttcttactctttggcacaggtgagaccaggcaggcacactagggaggggcagatgtgagccgtgtaactatctcattcccttaggaagccctttttacaaaagcaaagttggcttctgtcatagttttgattcttctcaagtcagattctgagattaagacccaggctggcctgagactaggagaaggattatttgggaggttatcctggaaagcccaagtgaaggagtggagataataagacaggagagggaggaaagcaaacaaacaaaaaaagtgcattgatagggagaaactgctgctattaattgagctcaatcccactggagagtctctgagaaaccttttggtacgtggggatgctgggacgttattcactgactcctgtcctgtgttggttcagggtggactctaaggatattgactttcacacacttccaggttgcacctatatgtggccaagcaggctccctttgagcccaaggaagtccatgaagagacataagtttctgaggtgggaagctgtttactctaaatagtcaaactcaattgtggctgaactcagaagaatatttaggggagaaaaatacatgaagttctatttcctcattcacagggatcgtggcataaggcagactgcatgggttagggtagtttgggctgccagtaagtgtaacattctctgtgcgaaggccacattggttggttttctaaggatgcaggtgtgtctcatggcacaggaggccagagaagggctcagaaaggctgcagagcatgaacagaaccttactcattctgtctctcacttggtctccctcagtgtgctagctttccctctctcctttacacacaacactcacagacacacatgcacacacatacatgtacacacatgcattcacgcatgtgtgctcacacacagactagctttttctgtttttcttgtacatcttacatgttcctggtttaatcataagacaaatggcctctctcttctggtaacaattttatattcctggtcaagggagctaggttggcccacacatgagagggaacagtggaagtaggatgtgtaatgcccagaagaacaggcatcggaggagagcccaggagttgattctatatgtaaatctgttataataccaatccgaacaagctagtattctatcaaatagccaaatgcagaggtaagcaggaagtaagtaatatcttttgtgattttttaaaatgacacacagtagatgagctcagaacatatacagtacagtagccactgggcaaccattagataaacaagaaaagagccagaccatggggatgaaaccatctttaatcatggcaagtggaataatgtgtaaaaaagttatgctaatcataaaatggaaacgatacatgtccattttagaatcaaatggcacagaaaatatgtgagcatatcagcaccatctatctacattatacccttgagagcttgtagattctgagtttaacagcaccatatcatgaaaaatgacactggacaatttggattgtttttataccatgggtctcagtgagaaagtcagctttctctttcccaatgcaaataaagattagcaaatatatttaatatttatacctgttctggtgattcattttggcttttgaaagtgaactccaccataaaaagataaaaaccaatcttccttttctcattccttccattattcattcatttattgatattactatattataggcactgtgccactctctctgtagaagcgcctgacagtagaaacaagggcttcatcctcctggctatgatcatgaggctacaacataacactgtggctttttgagaattatttcacagcctatttccagagcaaagtaacaatgctgttttttttttggtttctattttcttgtttgtttgtttgtttatgaagtcaaactattatggtgatgttaccaacttctttcaaagcagaggccagggaatcaaggacgttgaggcttaataaaataaaagcaaagtatgtttgtatatttttcatgtgttaggactacaggtttccagaaaataaacctttagtgcataggcaattttatcattagagatttcaaaggggatatgcatttatcgctatcaacagagccggataaaaagatttttttctgactatttccataatgttccattatgtttttaaacatgaaaaatttattccaaaggccaggaaatcacaggactccaccaggtgtgataaggtcccaatctaataaaagtttaactatctctctggctattagtgtttatttattcaagaaaggtccagaatgttattttgaatattcagtgtattatcaataatcgtggggattgtgatgacagtagtggcaatgacaaaaataacatctgtattagtctgttttcacactgctgataaggacatacctgagactgctaagaaaaagaagtttaattggacttatagttccacatgtgtgaggaggcctcagaatcatggtggaaggcaaaaggcactttttttttttttttttgagacagagtcttgctttgctgcccaggctggagtgcagtggcacgatctcagctcaccacaacctccacctcctgggttcaagtgattcatcagccttccaagtagctgggactataggcgtgtgcctccgtgcctggctaatttttgtatttttagtggagatggggtttcactgtgttggccaggctggtctcgaacttctgaccttgtgatctgcctgcctcaggctcccaaagtgctgggattacaggggtgagccaccgcacccagctgaaaggcatttcttacatggcagtggcaagaaaaaatgaagaagaagcaaaagcagaaacccctaatagacccattagatctcatgagacttattgactaccacaaaaatagcacaggaaagactggcaccctggattcagttacctccccctcagtccctcctacaacacatgggaattctgggagatacaattcaagttgagatttgggtgaggacacagtcaaaccatatcattccgccactgactcctccaaatctcatgtcctcacatttcaaaaccaatcatgccttcccaatagtcccccaaagtcttaactcatttcgacattaactcaaaagtccacagtccaaagtctcatctgagacaaggcaagtcctttccacctatgagcctgtaaaatcaaaagcaagctagttgctttctagatacaataggattacaggttttggacaaatacagcggttccaaaggggagaaattggccgaaacaaaggagctacagggaccatgcaagtctgaaatccagtggggcagtcaaattttaaagctccaaaatgatctcctttgaccccagatctgacatccaggtcacgctgatgcaaggggtgggttcccatggtcttgggcaactcctcccctatggctttacagggtacagcctccttcccagatgtttcatgggctggagttgagtgtctgtggcttttccaagttcaaggtgcaagctgtcagtggatctaacattttggggtctggaggatggtggccctcttcttacagctccactaggcagtgccccagttaggactctgtgtggggactccaaccccacatttcccttcctcactgccctagcagaggttctccatgagggccccatccctgcagcaaatttctgccttagcatctaggcgcttccatacatcctctgaaatctaggcagaggttcccaaacctcaattcctgacttctgtgtacctgcaggctcaacaccacatggaatctaccaaggcttagggcttacaccctctgaaaccacagcccaagctgtacattggcccctttcagccatggctggagaggctggtacacaggacaccaagtccctaggctgcacgtagcacggggaacctgggcctggcccatgaaaccactttttcctcatgggcctccaggcctgtgatgggaggggctgctgtgaaggtctttgacatgacctggagacattttccccatggtcttggggataacattaggctccttgctggttatgcaaatttctgcagccggcttgaatttctccccagaaaatgggtttttcttttcttttttttttttttttccgagacaaagtctcactctgtcacccaggctggaatgcagtggtgtgatctcagctcactgcaagcttcaactcctgggttcacgccattctcctgcctcagcctcccgagtagctgggactacaggtgcctgccaccatgtccgactaatttttttgtatttttagtagagacagggtttcaccatgttagccaggatggtctcgatctcctgaccttgtgatctgcccgcctcggcctcccaaagtgctgggattacaggcatgagccaccatgcccggccaggtttttcttttctatcacatagtcaggctgcaaattttccaaacctttatactctgcttcctttctaaaactgaatgcctttaacagtacctaagttacctcttgaatgttttgctgcttagaaatttattccgccagatgccgtaaatcaactctctcaagttcaaagttccacacatctctagggcaggggcaaaatgccaccagtctctttgctaaacataacaaaacttacctttgatcctgttcccaataatttcctcatctccatctgagaccacctcagcctggattttattgttcatgtcactatcagcattttggacaaagccattcaacaagtctctaggaggttccaaactttcccacattttctgatcttctcagccctccaaactgttccagcctctgcctgttacccagttccaaagttgcttcacacattttcgggtatcttttcagcagcgccccactctactgctaccaatttactgtattagtctgttttcatgctgctgatgaagacatacctgacactgggaagaaaaaggaagtttaattggacttacagtttcacatgactgaggaggcctcagaatcatggtggaaggtgaaagacacttcttacgtggcagcagcaagagaaaatgaggaagaagtaaaagcagaaacccctgataaacccatcagatctcatgagacttatttactatcacaagaatagagtgggaaagaccagcccccatgattcaattacctccccctgagttcctcccacaacatgtgggaattctgggagatacaactcaagttgagatttgggcagggacacagccaaaccatatcaatatcttacttttgtattaaataatatgattcctgaagtagttactcatatactgccccatttatttctcataagaactctgggagaaaaaatctatcacctctgttttactgatgagtaaatgtagactgaaagaattcagatgatgtgtaagagaacacatagattataatgacaaagctatagctggaattcagtttctgtttggggatgttgttttgttttattttgatcttagaaaaaactaaaagttatcataaaagactttattctaactgcaaattcaaagataatgtttattcatgcctaggacaaaatttctattaacaatcaaatattacagaaggttgtgaatttttgatgacctgattatgtttacataagtctctaccttttctaaacctcataaatatgaaacctttgggtgaactcttcccagaactgatttccataaacttactgaaaatgagtaggaagaaagagctcaagggacaagtacttattgtgtatactctttagtgatacagaaataaaagaaaagttaaatacctatatttataaaattgaatcttttaaagtcagctgacaggtcaaaatgcaggtaacatttttaagcttcatgcttaaaaaaataagctttatttaaaaaaaaaaaaatacttacttggagccaggcacaatggctcatatgtgtaatcccagctactcaggaggctgaggcaagaggatcacttgagcccaggagatcccatctcaaaaaaaaaaaaagcaccttactttttacttcattgcctcagtgatagcagaccaacagggcattggtaagaatagttttaactatactcacaatcatatactggcttcagttgtactagcaacagttaaaattgaagacacattaagcatgtaataaatgtgaactatcaataagtgaaaccattagaactagtattaaaccgtttcattcttaacatcctttacagataaagaatcagagactgagagagcttaataataccactattcagttagcaagctattctgtggtttaaagagatcagtattgcctttaactttctggcttttagaatttacgcaattctctatcaacatggaggctcaacctgattttggggcattgtgtaagccagtagttttcaacctggagtgattttgacccccaggtgacatttggcaatgcctagagacatttgtgattgtcccatttggttggggttgctatggtatctaatgggagaggccagtaacgctggtgaacatcctacaaagcactgcagagcccctggcaaagaattttccagcccaaaacgtcagtggtgctgaggttgagaaaccttgatatagccctctaagactgaatattaatgaaaatgtttatttaaatcagtttgtatggtcccagtgccacttagaattatatttcttaacaagttagagctcaatttcctctgcccaggcctccttaggatacagaagaataagccagtagtacccttacacggaacaggatagggcaatcatatgattctgaatgccaaggggactttcagattgatggtttcgtaaagtgactgacaccttggacggttcccaagaaaattactaaaacttgagtcttttgcaggtatgcaaaacccatgaatttcataaaaaataaatctttatttcaaagatgggacttttaaagtttaaagtggccttcgggtggagaaagaactaggaatcaaaatttcaatgggcaataaaaacaagtgataatttcctttgattctcacaatcaagatgaagcaggattgtgataagagcttagcatttctatccactcgttgaaatttatcaaatgcctctccctgacttctcgcccttacactgaagtagatatccaaagacttcagatatatacactatggacaagtatttcccctcacttgcagaaattcaagtggcaccagcagtttggagacagaagtctcagtgggcgcaaggaagctggggtctggggcctgactcttccctgccattttggtgccccttcccgcctacccacgccctaccccaatgtgtggcattatccagggggttattaaatattgaaatacagcttgacaaacatctgataacaataggtggccaaggccgggcgcggtggttcatgcctataatcccagcactttgagaggccgaggcggatggatcacctgaggtcaggagtttgagaccagcctggacaacatggtgaaaccccgtctctactaaaaatacaaaattatctgggcctgatggcgggcccctgtaatcccagctactcaggaggctgaggcaggagaattgcttgaacccaggaggcggagcttgcagtgagtcaagatcgcgccactgcactgcagcctgagcgaaagagtgagactctgtctcagaaaaataaaaataaataaataaataaataaaaaggtggccaccagctgtgtcaaaatcaactagttaaaaggtggaaattaaatatgacagtggaaaaagatttctagttggagaatgaaaacttcctaaaatctaagatggctgccattaaatgatattcagattcttcccgggttcttgcttttggatgaataaatggctttttcttcctccaaagttctaatctgatgaatgtgtaatggagataaatgttttggaaatatctccatttgcctggctcctcggtgtctctgtgtaggactttctccccactcaggccaagcttccatctgtgagtggaagatggggaggaggcgaggaccgcgaaggtcacaataagaatgcaaatacagcagtaaaaacagtttaatattcaccctctgtcagcaaaaataggctttcctagtctgcagcaatgtactggaacagacgtaaaagacaggcgttgccaggaaatagggatttactaaattcctttatattcccatttaatatatcaagaggcagtcctggtatccttgatcatatagcatttcccaacaaggaggttagaaccagacaggaagaggagagaaatccacacatactcaccccagtaggggaagaaacaaatctctgaagctctgagcacttacatgactcaccgtggcaggaactaagctacccaagacaacttttaaaattattgcatccacagagtttaccaaatgagtctgaaatttaacatgtttcttttcccagcattttaaaatcaattcctcctttgaaactcctctccaattactcttcatctgtataaattcaaatatattttcattcatttactcattcaacaaatatttattgagcatctatcacgcacagggtgctgcgaatgtgccagtgagtaggtacagataaagtccctgccctcttgaaacttactttttagttggagagaaaaagaaaagtaaatatcatttctggctgtgataaatttcatgaagaaaaacaaacaagaacttcctggtcctcgtgctcactcccttccaacagttttgggggacaccaaagggacagagaggagtcaagccccagaccccagctgccttgtgcccactgggacttctgtctccaaaatgctggtgccacttgagtttttgcgagtgaggggaaatatctgtccatggtgtatgtgtccgaaatctttggacatctacttcagtgggagggagaggagtcctggagagggctcagtacatttcaaggtggtgagagcagtgctaacacgcagcgttctctgacttcctaatgtacctccctctctgccatcagactaaaatttttcaatagctgcttgatgcaatcactttctttttcaagacccgcaactgctcatactgcctgatgctacctcccaggccttgaacatagcttcaaataatgtgtttaacctatgcctggccgtaaagcctcccctctcaccacgccacctcttctaaagtcacataaaaatcccagttctctgtccacacatctaagaatggacactcctctgtcttctcttccctatctttctaaatctgacccttttattaagattcaaccagtttcctgcctgctctattccattcaacacccagaccacagtgatacctcctttgtctaatctttcacaatacactttagcacgttacagattcccaaatgtggaaagaaccatgctggtcttttagtctagcattaaatacaatgtgagtaacacagttataacctttctaataggtagtctcagactttcacactctttcctaatgtttttcaaataagtacatttttaaaaatgcaaatacacagtggtaaattaaattattttgattattaagcattcataatcataaagctatgaataaatctgtatgcttggaactcttatataatcgtaaaagaaaacaaacttaaaaattatattcaaactgaataacaaaattcattcattccaaatgatcaacattaatttaatgtgacatgtaatattttgctaaagtaaagtacctattctcaatgtaaatgtggtattggctactatcaaatgcaatatgtaatagtggggccttacttacctacaaaggccatctctgtcattttttcttaaagaaccttaaaaaaaaaaagttgtagcttcttactaaagaaatctccaatgctaacacaatataagcgtgacttaattacagggtgataatctagatcatgtggacttttcagcccattaaaaattaaaatgaaaaatctaaccattttcaaagaaacgcacatcttttatcatatgccttcatataacaagggtccagaaatccatgttataaaggtttgtactgattcaggtgtttatattttgactctgaaaatggatctatgtaaaatgtgctgacaaaaagggctatttttaagttttgtgcatttttccttatagtacctaaaaatgcatgtagcacatgctggatgttaactaaagattccttgaatatattatctctatttattttatttcttctgatgtgaatttgaaaaaacatttatttacagaccactaaaaatctcccaggaagctgagttagtggtgactgtttgattctaaccttctgaacaaatgttttcatgaactccatgaagctttttaataaacttactcctcacagtgatgcaagtcaaatttaagacagaagaaactaaacgttcatcggtataagaaaatctaagtcaaggtggccaaaaaatcaagcaatcttttaagaatgttgaatcaaatgtggttgttggtgaatgaaaatttcttctattgcagacaattatttgaagggtacatctttttaatactatttccaactgtctcctagagtgatagtagccctgttaaacaattagtaaaacaaacaacaacaaaaaacacattaggccaagtgcagtgactcacgcctgtaattccaactctttggaaggccaaggaggaaggatcacttgaagccaggagttcaagaccagtctgggaaacatagtgagacccccttctacaaaaaaataaaaacttagcccatgaggtggcacgcatctatagtcccaactactcgggaggctgaggcaggaggatcgcttgagcccaggaggtcaaggctgcaatgagctgtgatcatgccactgtactccagcctgggaaacagagtgagattatatatataaaaaaaaatccctcctatctttgaaattttcatagagccacctgtagtttggatgtttcccagggaacacaataaaaacaaattcaataatcctcaactaaaaggcctgatatcatgtttatgccagttttttttcctgagtattttaactttttttctctacttagtttcatcaattaaaggcttattgttaagggagaaaagcattaggacccctagtaagatgctccagggagtgtgttttcagctcaatgtaagaaaaaaatttttgaaccgtcagtactctttgaaactctgtttattccaagatagtgaggtgtctcttaatataacagcttatacaggggctgaatgatgccagctttgggcttaatgttgtttttaggttatctagacagttctgattttagaatgttcataagttaggtctgaattaataagccaataggttcttatttcaaaagaatatatatatacacacatatatatacatatatcaaaaatgtgagctaaattcccatttatctttagtattctccatatctctttcatttccagagtaatggtccttgggaagataatagctagcataatgagacctggtacttacacagcactcaataagtacaagactctctaaatgttcattcctcacaaaactctatgagatacattatagtgctattccccttctacagataatggaactgggacactaaaggttaagtgatgtgctgatacttccaaagctcataaacagaagagtcatccagagccaaactattttggcttcaaagtccaggcacttagacagtgacgctatccactcactagtaccttctggagaagccactaggatagtctgagaatattactggactactaaacaaattgagattcttgaaagctgaattgtgttgtgtttttaccccatcatcacaaacctttacatttgttcagaccaggaaaataaatgtcagatgccaatgtagtgacactatcaactcccaggtgtaatcaagtagagactgagatccctacaccaagtcaaaaacttttatttctttgcatactatggaccatggtgtcaggaataatcacaacccaaagaatcagggaatacagaattttagagctggaagcatttttaggaattgttcattctttctttgttattacagaaatgaggatactgacttctactgagaggatcgtatttcaagaccatgtgatggctttataactgctctttctgactctactgttaactctctcatgtccaggctcataccagccaaaggaaattcgtaataaaatttgatcctctctataattgctattcctgattccactgttaactctctcatgtctaggctgataccagacaaaggaaattagtaataaaatttgatcatctcattctgcttctttacactccttcaaatgttctgcattactttgagacttaatcaaagtccttcagttaaagcatcagttctttgaagacctggtccctgattgtctgcagtctcatcagctcctacttgctcctcttgaaatctggactccagtcactctgagtgtcactccagaccccccagaacatcacactcttacctccatcctttacacatctctttccttctactttcacagcacttcccctggactcttctgtctgcctccacttcatttttcagaatgcagcttaatacctccaaagaaagtcacctctaacccagaggtcacatttgttctgtttagttattcaaactcccaatttaaacaagtctgcctatattgtttcctaacctatgacagatataaagagtaagttatatttctgtgcattaggatacaagaagagcaattagaatttgcacaatgcaacatgacatctccagtaacaatatattgcaaggattcactacttataaaaagggaaacaaggagggcagatcacaaggtcaggagatcgagagcatcctggccaacatggtgaaactccatctctactaaaaatgtaaaaataagctgggcatggtggcacgtgcctgtaatcccagctacttggcaggctgaggcaaaagaatcgcttgaaccggggagttggaggtcgcaatgagccgagatggtgccactgcaatccagcctggtgacagagcaagactctgtctcaaaaaaaaaagaaacaagttaatgaaacaaaattttctgagatcatttggtaaaggtgtcagattggtgcagcgtaatccagtgattgatgtaggtaattttgaaacctgagtcagcaagaaatagcaattatatttaatgtaatatgatgaaggaggcagaaaactgcaataacttagaatgatttccactaaagatacttaaaataaaatgagttttagtgcttatagcaaggaaaactccatttatgtttaacatctacttcttttaaaaatgtatacgatatagggggaagatggtaacagttagaacacccaaattctggtctggtaattgacactaaattagtgagtgactttgagtgagtaagccatatgatatctttgactcttagtataatgcagtggctaggaacaggggctataggctcaaatctcattctattccattactttcaagctccatagccttctgttactttaattgctctaagcctcactttcctcctttgaaaatggaaagaataataccttcctcataggattactgtgacaaacagaaggcacaacacttacaaaacactcagcatagaatatgacacataggaagagctcaaacagctgttgttgttgttgtcgtaatataagtagttacagtgagggagatagatcacatgctctccgaggtcttctcaaattctaaaattctgtggttctatgaacaactcgctcccaaatgatgtcagataaatgagatctcactgtatactgggcaataaaatcaatgtggtcaattttaaatcgtaccctgtaaggtaaggttgagcaggtcatgaattattcaaaactttggttacactcaatatatttctatttgatcatggaatgcatagaactatttaaaagagcatttttaaccttctcatattatgtttaatgattaaaatgagtttgatctttccgtgttcactaagggaaaagaaatggagcaatgctggatagtttatatatgtgccccacttaatcattagcgatttaggtgaaatcatcgagcaactttttgggtaataaaaaatgcaagcaggatatacagttttggcccagataacagacatgcctataaatgagagccagtggcacatcatctccttatgaagctttttcagaatttcaggtagttcaggtccatatgtgctttgaaattctaagggtgagaagatgactatcacgtgtttttccaattatatcttaattttcaaaataggcttattgcagcattgatgtctaattagagttgccggacacagtggctacagtccaatgctataataatctaattaactaaactctccacttatcatgtaagtgcctcctcacctaccacacacttcaccatttaaagtgatatccttttcctttcttcttttttaaatgaagaatttgttcagggagacatttggattgttcagtggtaaaaaaaaaaaagctccaaaaaaaaagcaaataagaaagtaagagtttgtactggacagcagaagtgacatcacctgggcaggcagagcacctgttgaaatccaagacttcatttacggactagctgtgtgactttggcaaattactaaatctccctgagacttagcatctttatttgcaagctgggaataatcggaggaagttaactgagaagctattgggacttaagcttcagggccttttatttgtgtagggcatatatgttcacatagtcatatgcttatgttaagtttacaatgttaagataccttaactgtgactagctaagagctctgtctctttcagtatgactttcttccatcacatggtgaagatctttggagaaaccttgaacaggtttggtgtcatgctaagggaaagttgagatccataaatttgtgtttagtgacaatatttatgtgctctgaagttatttctctatattgtcacatattgctaggcatctagtgtaggaataattttcaagtgcactcccagtgcccatgttcagacctacatatgtatttgtatttaaatatttcaatcttttcttaaagagagattccaaaatgacattaaattcaagctccagaaaacctagattttcctttggggataatgatatgctgagaccagctcagctggggagaccctaacccagcagtgctagaggaattaaagacacacacacagaaatatagaggtgtgaagtgggaaatcaggggtctcacagccttcagagctgagagccccgaacagggatttacccacatatttattaacagcaaaccagtcattagcattgtttctatagatattaaattaactaaaagtatccctcatgggaaacaaagggatgggttgaattaaaggaataggatgggctagttaactgcagcaggaacttatccttaaggcacagatagctcatgctattgtttgtgacttaagaatgcctttaagcggttttctgccctgggcgggctaagtgttccttgccttcattctggtaaacccacaaccttccagcatgggtgttagggccattatgaacatgttacagtgctgcagagattttatttatggccagttttggggccagtttatggccagattttgaggggcctgctcccaaaaatgacacctaccttatactatttctatgaagattaatgtgaaagttttttcctactttcctttgtttgttctgttttgcattctcattcttattctgaacaactctataataaggacatgaagattatctaattcagagtttttatgttttattcccaagcacttctaccccctcaaataaaaccataggcgtgatcttgatgcatgtaataagccagtaattgacagaatttatatgaagcttaaccctcactgtttgggtatatccatctctcatttctgtaaatctccaaagaaccatggcgagcctcaggattccatacgctccatttgaaaacccatgatttaactcaattccctctttttataatggaaactaatttcagagaggctaagtaacctcttgtcttcccattctatgttcaattcaccatatcttttctgtaggtttatgatagcaaacaattgttattatttattagttttaaacacaaagctacctgttttaaacaaaacaatttataaatattcttcatgtcatggaatatttattctagaggaattaaatctttaaatataagtgtttccaaactggaagaaaatacagaagactacatgtacaaatgaggctttgaggtaacctattaccaaagccatcagagatctgtaaaaatctgaaacttttgtgtgtaaatgtacaacatataatgttgttctccacatactaaattggcaaattatgtttgcaacagttatggcacatacaaactgctcttagaaatataaattatgcaaagaatgatgactcagaagcccacagaagagcacatttcaatggccccagacttccaaaaaaaaatttcaggctcctggtaatgagagaaatgcaaattaagtagcaatgaagctctcacttcacatccatcagagtggcaaaaaattaaaagtgataataactactgttggtggggatgagttaaaagggtactttcatttatttctggcaaaaatgaaaattgttataggctttcagaaaacaattttgaaatatctattccaataaaaaaaaaatgcaagtcctctttccagggccacagcatgactttcatgggccctagaaacttgtgcctgtgttgtcttctttctctattaatattatatatatatgtgataagatttggctgtgtgcccacccaaatctcatcttgaattgtaactcccataattcccatgtgttgtgggagggacctggtgggagacaattgaatcatgggggcagttcccccatactgttctcgtggtagtgaataagtctcacgagatctgatggttttataaggggtgtccggttttgcttggctctcattctctcttgcctgccaccatgtaagatgtctctttgctcttcctttatctttccccatgattgtgagcctccctagccatgtggaactgtgagtccattaaacctctttcctttataaattactcagtctcgagtttgtctttattagcagcatgagaatgaactgataatacacacacacacatacacgtactcatagacatatatatgtatgtatacatatacagacagaaaatatattttatgattgtgttggtgtaaagaggaatataagtcaaactgaatttattattactggatttactttttcttaaatttttaagataaaaatattccctgaatccctaacatcttgtgggccctgggcacgatgccttttgtgctcaacaatacaagccctaactcctcactcagaaatttgtctactgaaaccagaactttagtgatgtttactttcagcattttggtagtagcaaaaactagacacaaagtgaaaaccttcagtgggcaataattgagtaaatttggttagtatgataccattttagaaaaaaaatgtaagccaacacaactgtgtgtatgtgagttgtctgtgttagttatctattgcaatctaacaagcctccctaaaaattaagtgcttaaaacaacaatcactttatttacccatgattcgaataggttatcagtctgagataggctcttctgaataattctttgctagtcttccatagggtaattcatgcagctgtagtcaaatgacagcttgcctggggctgggcagtctgtgatgtccatgtccttccacacaagtctgatggttagtctgttcctcagctgggccatatgctgccagcaagccagcccagctttcttcacataggtttgaaaagcaacttttaaaacctaaggttgcatcactgatatgatttgactgtgtccccacccaaatctcaccttaaattgtagctcccataattcccacgtgttgtagagggacccagtgggaaataattgaatcatgggagacaatttcccctatactattctcgtggtagtgaataagtctccaagatctgatggttttataaggggtttcccctttcacttgggtctcattctctcttgcctgccgccatgtaagatgtgactttcaccttccgccatgattgtgaagcctccccagccatgtggaacagtgagtcaattaaacctccttcttttataaattacccagtctcaggtatatctttattaacatcatgagaacagactaatcaaatcacatttgctaatgtctctttaatcaaaacaagccatatgatcagacccagaatcatggtgggagggccctgacaagagcacagatgagaggaggtatgattcattaaagaacactactgtaaaattctgtcaatgtgtgcaattgcatatttatgtacacattatcatgttggtatggtaaagatcagcaggaaaaaaagaaaatggaactattaataattttattcagatagagtgaagttacttactgtttaataacagtttatattacttatatattaattcattaaaagctgtttatcaagtgcctactctatgctagatgagtgctgagtatagaacaatcttctggaaaagtgaacatcaagggacatgcccacaactaagaccgtttacttagttattgtaacaccatcttttgaggattaaaaaaagtagatatgtacttgtgcatcataatttcttagcctaggacaaatgctttattacagttaaatactcaatatgatttgtgtgaccccttggagcttgggtgaagccagtgtacagggaaaggagaaaagccaatacaacagtgcattgtcaagttgactgtggtcagttgagtcaggttttcagtcccagggcagctccctgaggaaacctctgaaacacatcgcagatctttctgcccaggagtacacatggatgaaactgattctcatcccctttgttcgagtgactccaagggcattgactttaccagatttttggcatatgcatgcatgaggccacatcaatttctgagactaaccctgctctgcagtatcaatgaaaccctcagggcaagaagcaagaggaacagggcagatgctgtatctgtgattagctaatcaaaacctaggagacattggttaccacagcagtggctgcagtaagaggtggggccaaaaggatataaattagtatacaagaagtgtctgatacagcccaccccttgcagaactgagacttgctcatgtcttctctcaagtctaatctgtcataaagtcatcttcaatctctgcaaagtttcaatacaaaagattggcagaataagtgataatccctgtattacagctgaatccaaggcaataattgatattatttatcctttccttcaactcatcctaagccagtatttcagctggttgcttgactgatgcagtgacccagactttcatctcctggagatctaggtccttagttaccttgctcttcaccagccactaatgctgcggttgcttaatcaccattaacactgagcacagaagcagcaacaggtattacattcaatcccctgggctccagacattcttctccctgcctgctagggggcagcagcgctgtctcctcagctcattcagataagctacctttgccagaacagtagtaactcctttctttgcttgatggtccactggcatgaggagctttgtttttgtttttatttttgtttttttgttttgtctttatttcttctaaacacacacacacacacacacaacaacaacgggatacatgtgcagaacatgcaggtttgttacataggtctacgtgtgccatggtggtttgctgtacctattgacctatcctctaagttccctccctgcaccccacacaccccaacaggccctggtgtgtgttgttcccctctccgtgtccatgtgttctcaatattcaactctcacttatgagtgagaacatgcggtgttgggttttcttttcctgtgttagtttgctaaggatgatggcttccagcttcatctatgtccctgaaaaggacataatctcattcctttttatggctgtgtagtattccatggtgtatagtgccacattttctttatccagtctatcactgatgggcattttggttggttctatgtctttgctattgtaaatagtgctgcagtaaacatgtgtgcatgtgtctttataatagaatgatttataatactttgggtatgtacccagtaatgggactgctgagtcaaatggtgtttctggttctagatccttgaggaattgccacactgtcttccacaagggttgaactaattttcattcctaccaacagtgtgaaagtgttcctatttctccacagcctcaccagcatctattgttttctgactttttaataatcgccattctgactggtgtgagatggtgtctcattgtggtttagatttgcatttctctgacgatcagtgaatttgagctttttttcatatgtttgttgggagcctaaatgtcttcttttgaaaagtgtctgttcatattatttgcccactttttgatggggttgtttgattttttcttataaatatgtttaagttccttgtaaattctggatattagacctttgtcagatgggtagattccaaaaattttctcccattctgtaggttgcctgttcactctgatgatagttccttttgctgtgcagacgctcttcagtttaattagatcccatttgtcaactttggcttttgttgcaattgcttttgacatttttgtcatgaagtctctgcccatgcctatgtcctgaatggtattgcataggttttcttctagggtttttatgattttgggttttaaatttaagtctttagtccatcttgagataattctgtataaggtgtaaggaaggggtccagtttcagttttctgcatatggctagccaattttcccaggaccatttactgaataggagatcgtttccccattgcttgtttttgtcgcatttgtcaaagagcagatgcttgtagatgtatggtgttatttctgaggtctctgttctgttccattggtctatatgtctgtttcggtaccagtacatgctcttttggttactgtagccttgtagtatagtttgaagtcagatagcatgatgcctccacctttgttctttttacttaggattgtcttggctatttggggtcttctttgattccatatgaaattttaaacatttataattctgtgaagaatgtcaatggtagtttgatgggaatagtattgaatctataaattactttgggcagtatggccattttcatgataatgattcttcctctccgtgaggatgaaatgtttttccatttgttgatgtcctgtcttattttcttgagcaatggtttgtagttctccttgaagaggtccttcacgtcccttgtaagttgtattcctaggtttttattctctttgtagtaattgtgagtgggagttcattcatgatttggctctctgcttacctattgttggtgtaaaggaattcttgtgatttttgcacattgattttgtatcctgagattttgctgaagttgcttatcagttcaagatgttttggggctgagatgatggggttttctaaatataaaatcatgtcatctgcaaacagagacaactggacttctaacctgcggagctttaagtgaccaggtcacagccattctttgaagtaaaggggaacccatatacttgacagatatggtaagaccaatgcctcccatggcaaatcctgctgaggtctataaaaagtagtcaccacagcagttctggtataagggatgagtcaagggatttgaagcagtgggctcgatgtgtctgatatagtaatatgtaatctacatagaggagttaattatccacaccatgtcttcttttcttcccccatttcttatcacatacaccctggaatcagagctatttatttaaataacacacgcattatatttgaattatttggttgcacatgctgtataaagcaatacattatttttattagaatgtcaatgatcatataattgtttgataaaaatttttcttttatggaaattttctctgaggggggaatatcacaattttcatagaaggatttagaagttgcactatataatgagaaatgagtactgcagatccttagcaaatatgactttattcttccacttttaacaacataaatgccttggaaaaaatcactcaatttgatcatgattgaaattcccggtggaaaaatatatttgggatttgttaattatttttcagtggggttctcttttttgagagagctgagtgatatggtttgactgtgtccccacccaaatctcaccttaaattgtaataatccccatatgtcaagggcagggccaggtggaaatgattgaatcatggggtggtttccaccatgctgttcttgtggtagtgaataagtctcatgagatctgattgttttataaataggagttcccctgcacaatctctcttgcctgccaccatgtaagatatgcctttgctcttccttcatcttccaccatgattgtgaggcctccccagctatgtggaactgggagtccattaaactatttcctttataaattacccagtctcatatgtctttattagcagcatgagaatggactaaatacactgagcatgagtggaagaaagtctcaaactgaagtgaagaaaaagggaaggggctgatgtggggagaggagcagtccctcagcagcaatgtcaagttcatttgctttgcctctggccactgaggaaagacaatgccaggcaactgtagagctgggccagcaccttctgaaacgatcttgttccccaaataaccacaacagatattatatagcaggtaaactaacaagtaaaggcagaagtgaaaaaaattgttctgtgaaaatatatgtactatatgtacatatagatatagtatatacgtttgtgtgtgtacttaaaccacaatgctgtaagaaatcataaatttatctgaaaatactgggtaaggagatagtatccataaaaaatactattcccatagaatttaaatattcagtgagctttcactgactaacttgcatacaccaggcactgtgctatcaggtatggatgtagcaaaaattatgatatggttcttatgtgcattaaggtaaacattatccagaaatatgtaggctttcttgttttcttaaattagaagacaaacagtataggtttctcctgttagctcaggtatatcattatcaggttcaactattctagcaggtggtaataaattgtttttcttctcatgctgtctgctgtaaataggatcaataaagtcagaataaagatcacaaaaactttcattacagtgcgaatagtttaatgcagcagtttctatgtgcctagattttggcagatgctttaagattctggaatatttgaaaatattattacttctctggtccttgattgtgtaaggaatgctgaagttattgactccttaatctctactgaaggggcttactttgaagactagcaatttcattatttgattctgattctgagatgactttaacagaatctcaagcaatgtaagccacatttagcaatcatagcaatagtctgatatttttgaaacctgtcctattataaaacaagcctacatttatataatcctcatatctcaaaagaagttggagaaagccactgcctgggaagttccttatcctgaacctaaatcagatgctaatatcttgttgctgcattggttttaacagtagactctcaaggatgctaatatcttgttgctgtttcggtttgaaaaaagactctcaacttgtattcatcgatgggtgttctctatttcttaacaggattatctatatttgaatcttcttttaactctgactgaagagctctgaaatcaccaataatgtcttcattactacatcaatacttaaataatggacaagaaattataaaggcttagcaaagacattcagattattatggccttttgaaatatgcaccataaactattaacttagagtgcttggccaaagtaaaacttgaatatcccatcaaattcctcatttttatgagaaaatttatactcagaaaatttaagtggcaaataatccaagtcatatggactgtaagttacagaaccaagtcacaaaaaggagttctgattcttgatctaaaagtcttcccactgtgtccttctatggccttcagttttgggcggtgtattttgtttgttttttatttgagttatatgcgagtttaaacacaattctttctgctatgggaaacggcctgtttcattttcaaattttgaagctcacattttttaatggtttattttttcattaaatttaaaaggctttatttaacaattaaaaatcagtcctattgcctcattcattgaattccataaattacagtaaaacattttaaagctgtaaattagtatacaaacgtagctatctttttattatttgaatcatagaatgactttaaatgactaaagtttgcatttagaattaacactttttaatttaaaaatctgatttttcatttaactgtgatttgtttagctaaaaacaaatggagaatttgaatttctttactccattttactttcctcaacacacacacacacacacacacacacacacacacacagagatataaataagaaaaatctacacttccaagagtcatttccttagtgaatcacatccctcacttttctccacactgtccttcaacaatgagaataaaatacgccttcttcctccataatatcagtagaaacaattcagcacaatgtttaaacaagtgttaggaccctgtagccagaattcctgtgttcaaatcctggctctgcctttttctaggtgagcaatcctagacaagttaactattaaataattgctttgagcagatggcagtgacagagcccttgaagaatagctctctctccaggccagcagaagaaaaatgacagtgcaagacacaggataggacagtcaagaggcaaaaagaaatacaagctaagggcacagaaatgaagagaagaatgtttccatgaggagtcagccaacaatgacaatgtctactaaactcctagagaatgagaacgtagtgaaagcccagggtaggtatcagtgacattcttgaaggtgagacagcagtgataacattctgacttgaggggctaaggtgtaagtggtgaagaagcaggagttcccctagattggacagggaaacgggactagcatgtagcacgtgtctacctgcccttgaatctaagatcgcagagaccagtgcagatgaatagagaagatgcagccaatggaaaaaagagaggaggtaaatggagaaaaccattaaatgatctcaggacaagcatggaatcacatggttctggggaggaagtgtaaggaaagtccttctcttgtcttccttgcaacctcctattcatcctataagacttagcataaaaccacttcacaaataaagtatttccaaactgtcctaaatcaacttatccagtttatttttctaaagtctctgagtactttgttttataatcttttataacatctaacaaattatatatattatttagttaacatgcctgccccatgtattacatagcaaattccccagagctaggatttatgacttttttacttttttcttcctagggcaaggtatagtgttagatactactaccacattagtaggtgttcctaaaataattagcaataagaaaggggctgaggtggtggtttgcgcctgtaatcccagcactttgggagggccaaggtcaggtgtaagagaccagtctggccaacatggtgaaaccctgtctctactaaaagcacaaaaattagccaggcatgctggcgcgtgcctgtaatcccagctaccaaggcaggagaatcgcttgaacccgggaggtggaggtttcagtgagccgagatcgcgtcattgcactccagcctaggcgacgagcaaaactctatctcaaaagaaaagaaaaaaaaggaaatgagagagagaaggttagagatgggaatggagactcaggagatgcagcaacataagcaacctctataggatctgagcaagatgaactggatgctaagcttcttcgtccagacccattaaattgaggaagcgtgtttgtagcatgcctgttggattttgtaggctttctctccttcttagagttttctataacctaatagtaaccctgaataaaatacaagtagagttgtttaggtttagtcatgtaatacaggaaaatttgatatattgtggagtgcaggtcaaagaataccaagaatggatattgaagtctccaggaaatatggcaatcacagtgatacaggggcaaagagtcctggttttgtgactggcattgcaatagtatggattatttttttttttctttgaaacagtgccttgaagccaatttatagagggatttgggaaggatcaaacaaaagaaaaaatgggctgggtatggggaagggagagagtagaaatgaaataataaatgtagatatactctggctttcagaaactttttgaaggacttatcaagtaaaagaactacaagctattgtaatttcaacaagaaattgaaactttgtcttttttaaaaaaatcctaatttcctccctccccttgaggcttggacaggtaaataaacccattagggggctataatgaataacatctcatacagaaattatatgcagggaaagatcatgacacaatattagcatacagaatatctgtttttaaatccacattctctctaccatcttcatttgctgtgtgctgataatgagacaatggttcctaagggaaataatgtagtttactcagggtattcattcaagctctaaaaaaaaaaaatccaaacagacagagaacatatgaggttaatattcaagtgttaatgaggacttaggtattgtgaagcttatattgtactaattaaaaataattgcatggtcctagaattagagagctttcactgaggagggtctcaaggtcattgccgcctctctggatttccaacttggctgtgcacaaacctcagtggttaccttaacaggaataattaggttctgggcaaacacattcctgcaaccaaattcactagagtctgttgagataaaaaagtcagtttcatggtttctaatgagaattacctctttccaatatagaaacttatttttgaaagcaagattaggatcagaaggtggtttcatggttaaaaagggagcagaataaggagggccccagagaccatcctacactgaacaataccaacccagataagccccatataaactatatcgccgctatgcctacgttttacatgaaaaggcttctttatccattcaagggtagaaattcccagaaaaccaatccctcattttagcatcttataacctggtccctacagcaagtatgtacaagtatatagtaagcatgtgatcgcctccagtataaaagagcagaaaggtgagggcattcataagcgattgatggatacgcaaaatgttatattacagcatttcttatcaaaattagatttaaaattatttcatgctttttcccagtttcatatcaaatcattaaaagtgaatatttttccctcttctgtacagtcaggaagactgcttatgatgttccaaagataacctttatgtatgtgctcagctttgacttatgagtaagtttctcacatgggttaatacccggccacttctagtgatcctcatgcttttcaaggtcacaacaggaaggatgtatatttcaagtttaattgtttctctcaaagcacgaggagtagacaggtgtggagagagtcttcctcagctcatcagcgtcatggaactctagctcttctcctagggaatagggcctccttcatgtttctccccctaccctatccattctttaatcgatgctttatttcccagcaattcatgcctgttacttgtctttactcttaaaccttttgcttttctctttctgccagcattttggcaatcctgtataggcctgcggccacgtctgcatgtaagcagagagcagaatttctgctttaacagaatttctctgtcacatcgtctgcttgggccatggtgtttcgtattctactggtagacataaccttcaaggctatgtggacctttaaagtcagtatgaaaatttgacttcattcttccgtctttctttattattctgcttaatataccttgtgttcatccacaacactggaagcacattagttgcttaataaaagttattctttaaatagagtcatcatttttatatagttgtgatattatttccatacattatttatataaaatcatattattttatatagtttttatatatctgtgataaaaataatgctccccaccagaggttcatgtcctaattcatggaaccagtgaatatgtaactttatatggcaaagggactttgtgcttgttaagagccttgatttgaggagattatcctggattatctgggtggctttgtgtaatgacagagctccttaaaatagtcagagaaagagactatgaaagcagagagttgcagtgatgcagcaggagggaaattccacctaattcctagctttgaagatgggggactgagatgatgagcccaggaatgtgtgtggcctctataatctggaaaaggcaagtatatagatttcccccctagaatttgcaggagaaacacagtgctaccaacactttgaatttagcccagtgaaccccatttcaaacttctaaccagaactgtatcattattattaacagaatcatcatctccagaactgtaagataaattggtgttgttttaagtcactaagtgtctgtcatttgttagagcagcaagaggaaactcatacaatagtacttcatcattttccatgataggtaatacacagacaacattcattcattgtttaatgaaaatgaataagacatttagtggctgggcacagtggctcacacctgtaatcccagcactttgggaggctgaggcaggcgggggtcgggaggctgaggcaggcgggggtcaggattttgagaccagcttggccaacatggtgaaaccccatctctactgaaaatacaaaaattagccagacatgttggcaggcacctgtaatcccagctgcttgggaagctaacgcaagaggatcgcttgaacccgggaggcaaagattgcagtgagccgagattgcaccactgcactccagcctgggcaacagagccagactccatctcaaaagaaaaaaaaaagacatttaggacttgtcactgtctaaatttttgcatgctatgaaattcaatctgatatgttcagtagtaatatttctgaatagctgatattatgaatatatagcatgagaacttttacttgggacttggagttgcaacagagaaaaattactttacaaataaatcaatagacttgatgagtctatttattttgccatcaacccaattacctttctgttcttcagcagtctactggcaaaactcaattatcgacaatggttcagacccttctgtttcttcagtggctgctgccttagctcctgtgttctgtcatctcctagggcttaatgtgcaaaaattgtgcaacccagctaggactccactgggtgcagagctaactggctgaggcatgcagggtaaatactgtcattagctcattctctgcataaaaaaatgaaatatactcaataacttctagtttttgaagtatctgattttatttaatcttcacaacaacttggtgaagaaggtattactattaggttgctacaaaagtatttgcagtttttgccatgacttttcatagcaaagccgcaattacttttgcaccaacttaatacctcaattttacagttgaaaaaaccacgttagggagagtatccaggcggtaaatgacagaaaggagatatgatctaaaatttcttaattctttattcagatgataaaactaatgtgactttgctctatcacagctattcttgtcattttactgcagtgtcaaaattctagatacatatttttaaatgtattttaaagacaaaataacataacatatgcacattataaagtgatgtaggaaatttaaaaatctgtgaacagttttaaatcacccacaatattactgctgaaaaataacacctcttactatttttatgtatttataaacatttttctgtgtatttatatatttcttttgacattatggttttgcatcccattccattttatcatatttccagtgaagtgaggtggcattctaaccttatcatatgtacaattttactgtattgtctttcagtaacctacttttgctggatatttaaatataaataaaaattagtctaccttgaatttaccttttttcaggatgaaatctatgcttctccaaatgcagtctgaggacagtagtgccagcgtcatttgggagcttgtcataactgcaaattctctactgagtccaagtctttggggtgaaatccaggaatttctgttttaataagctctccaggtgtttcacacatgcagaattttggactgaagtgtttggttttctgtaagcgttgatgaggcaaagcagcttaggcctattgtaggtgaaaggcaagcacaataattgttatactttgaagaaaaagaaaacttttttccttcgttcgttctttccttccttccttccttccttccttccttccttccttccttcctttcttccttcctttctttgagatggagtcttactctgtcacccaggctggagtgcggtggcacaatcttatctcactgcatccttcgcctcctgggttcaagcgattctcctgccttagcctcctgaatagctgggacaacaggcatgtgccaccatgcccagctaatttttgtatttttagaaaagaccaggtttcaccatgttggccaggatgctcttaatctcttgaccttcagcccacgttggcctcccaaagtgctgggattacaggcgtgagccaccatgcccggcctaatattttttaaaaatgtctgtagagatggggtctcacaatgttgcccaggctggtctccaactcctggctccaagcattcctcccacctaagtctcccaaagtgttgggattacaggcatgagccaccgtgcccggcctaattgttaactctgactgagaacttttgtagattgagaaagtggctggtagtatattgtagataaaggccacaccagaaagggtgagtgtgaggtaagcgagctcctgtggggaatttgcctgaccagagcacaacattcacattggcaagcagctgaagccaagaaagacctgttaggataacccaagttcttgtacacatagatgaagatctgtgatataatttatagatattgaggaaacattacacattatttaacataaaagtgatgtttcataactagaagaacattggttaaaaagcacactttagtgagaagtgaggagatatttgggtagaacaaccaatgaataaggtgagtgttgtaaacaagataccaaatgaaagacaatgataaggagttttggcagaagaaaaagacaatgatttattactaaatattataatggaaaagaaggggaatggtttcaatggcagattggacaaagggactaagaggaaaactagaatttgaacctgacatcctggtttctcttgagctatacataccaattttaataatctggagagaggtgtaaaaaattaacaaaacagttttattttcaaagattgtgagtttagtttactcttaactcctctgtattcctaatcacctacatccagttggattctatgtcttgccgatcttaaaaaaaaaaaaaaaacatttgaggccaggtgcagtggctcacgcctataatcccagcactttgagaggccgaggcgcagatcacctgaggtcgggaattcgagaccagcctgaccaacatggagaaaccccgtctccactaaaaatactaaattagccgggcatggtggcggatgcctgtaatcccagctacttgggaggctgaggcaggagaatcgcttgaatctgggaggcagaagttgtggtgagccgagatcgcgccattgcattccagcctgggcaacaagaacgaaactccgtctcaaaaaaaaaaaaaaaaaaaaaaattgaatcagtcctatttactctattctttgtcatattgctttagtttaagtactggtaatctttcaactggcagcctatagttgaaacagcctaaatactctttttaccttttgaattacttccctaaaacctattgcattgctgcacagagttttcattctgtataagttgatataaaacctatattgacttatggcatcttcctgctaaaagtttaaaaatacttttcctctgctttttattgtactgttttacttggtatgacattctgaattagagcagccgtgtagtttatcatctgaatgagacccttgggacattgaaagtgggcatattaataattacactgggacaaaagttgtctgggctttgccgagctttctagccccatcctcttctaagagcagtttacaaatgagcaataccaaaataattagtgaacaaacacggtttcgaaggtcttctatccgtgttgttcacagctgtatctgcaatgcctaacgcactgctcagtgcagcatagttcctcaataactatgtgcaaagggaggaaatgagggagggaggcatggaagaagaaatgggtagatcaaagaattttagaaagcttgaatctagtatgctgttgtttaaatgacatagagttgaaggtctaacatccttggaaagaggaaggcatagaaagccaaaggaggcacagagaacttggtagaggaaggttaaaaaagggaggtcccagaatcagaccacccatgaaactgactttctgattccaaccaggctctagtgaatttgactggagaaacaagtttttccagaacctaattattcctgttagagtaactactgaggtttgtgcatagccaggctggaaatccagagaggtggcaatgaccttgagaccctcctcagtgaaagctctctaattctaggaccatgcaattatttttaattagtacaatataagcttaacaatgttttgtaatttattttgtactattttatagtttaacacacaacaacccctaaggagtgtaattcaagtgcaacttacccaaagacttcactgcttttgtatcaggttgacatatttttaccgaaaacatatcttagttttgtgaagaaaactttcacattcttcattaattcctgggcagagctgtttaaaagaaagttttgtcagtagcattttagatgttctaactacaaaggagatatgtaaatgtccgttttgtacttctgaaaacaggtgcagtctcagtgagaaaaagaaaatttgtcatgagcactggaataaaaagggaaataatgaataagaacataatttaattacatgaatgtcagccgtctacacaaactagatttgatgtaattaaagcacctggaacaaataaaatgaatcaaggaaatctctttcctttttttgagaaaggaagattcaaaattacatactatttatggacaacttgtacaaactatgcaaaaaataagtgtgcatgtgagtgtatgtgtgtgtgtgcacaagagagaggcagagagagtgaagggtaatttttcctggcctcttagttcataaccaacaaagcagccaatataagttttttatagtaaggggataatatctataaataagtagaaattaaatattgttttcaatgatcatgagccccagtaaaataaaaattacatttatttaaggattgattattttagtcttttccccaacataaagtcataccaggagcttgctgtctttggtaggtcaggaatgcttatagagaaagaaacaaatcatgaatttaaatttagagacaaagaacgctctttccaggaagaactactcctaactagtggtttgctagcattgcaatatgccactgggacatttatctggggagccatttgttctgtgctgtgcttatgtaggatattttgtttgttctagctatctacgagccttcctgtgaagcctacaaacacctaggacagacatcaaattattactggatagatcctgatggcagcggacctctggggcctctgaaagtttactgcaacatgacaggtaactgtgtcatatttatgttttatgaagatgcttttctatatgtcacgaataagtagttccaccaatggtttgtttctttggtgctatgtttttatcacaacatctaatcagcaacatattgctggatttgttagataagatgatgaaatgtattattagagcaataaaacattttgacactgtgcttttcaaaaagttcatgtttgatgtgaacaattaagcatcatttttttaaaatcagcatgtagggggaaaaaaacagaaagtaaagttgcaaagttcagcccaaagaaagaactagtaacctagattagggaaatttagcatcactgctccaatattctcactgtgcatgctagaggaagcttttagatcgtgacagaccttcctcgattctccataatgatagaagaaatctttctaagtcctgaaatcccattctgataatagcaaaaattacctgaagcttttatgaaatatatttgggcttttcttcttgggaagaggacctagtttttctccacttccatgtgaaatgagattatgggttcttgtcaacttccacaacaatgtgtaaaatgtgcagatctctaagataagaacagattttccatcagacacttggcaatatcttacgcttcaaaaatccagaggaaggtgtgaggtatgcattatttactggctccagcaaaagaccagcatttgatgtgaactcctgggcataatatgataagggtaatgataataagatgctactgatggtagttactgagtgtgactgtttaccatctgtcaagtatcatgacaaatcctttggacagacacttgagtttacatcctggcttcattaatcaccacatgtgtaatattgggcactttagtaactttgctaaattcagtaaacctcagaatctttatctgtaaatgaattaatgagaatacccacctcatagcattattgtatgaatacaataaggtaatctgcatatggttcttagcttattgtctaacacacggtaaaccttcaataaaagttattggatgaaaaaatttaaaggctttagtagttaaataacttgcccatattagaccaggtgtggtggttcacgcctgtaatcccagcatcttgggagactgaggtaggtggatcatgaggtcaagaggtcgagaccattctggccaacatgaggaaaccctgtctctactaaaaatccaaaaattagctgggcttcgtggcacacacatgtagtcccagctactcaggaggctaaggcaggagaatcacttgatccctggaggaggaggttgtagtgagccgagatcaagccactgcactccagcttggtgacagagcaagactccatctcaataaataaataaataaataaataaataaaacttgcccatattattcaggcaaattcaaactgaattatatgcagcccatggatcttctggctatagttcagaaccacttatagagttttattttgtctttggttttgttttctatacaaacttcttggctccacccctgcagactctgattcattatgtgtgaagtggaaatcagattgtaaaactagaactgaaaaccatgaatggtactctaggcaagcagacaccagcgaggaactctcagcagtatcaggaagccaggcatggtacagaatgaaagggaaaatgatgagggcatcagtgtagtatggaagacatgtggagaagataataaaatggaagctgaccagcctgggcaacatagtgagaccacatctctatttagaaaatgtcccagctacttgggtggctcatgtggaaggattccttgagccccggaggttcgaggctgcagtgagttgtgatcacactactgcactccagtctaaaagagtgagacctgtctcaatttttttttcaaaatagaaataaaaaaataaaatgggaactagcgtccccctaaatttctaaatttcccctagaaatatgcaagatgctagctcccagtttaatttttttttctattttgaaaaagaactttaggcatgtctcagagaaggaacacacttaccagagagattaatctaagagttcactgacagctggacttgtcaatgcacttgaattcttttttatataccttcatttttatctttttagcactaaaatattaacctatgataacttgacttaatttataagaatctcgattctggtttctcctaatatatgaaaatatataatacaattaaagtctattcttaacctcaagggaaatcagggcatcgtggcttggactggacaattaagaatttattttagttattttcttaaattcatctcaaaggaaattagaaaagaaaacaaaactataatatacataattctcatatcaaggacacacacaacacacaggactagtctactctcaggagagcttctcctgtgcattgaaccctttgctcagaaacatatgtcttatcttcatcaatatctcccttaaacagcatggctgcaatttaactcagcacttcaaatgacttctgagctctaaggagcagaatacaactttttgcaagtagaattttttttctattcattcaagatagttacaaacatcagtgtgttcaaggacccttgaagaatcttgccttacaggccagcaggcacctttcagttctttgccactaaccaacccttccttttcctggaaagaatgtggatttaacatcataaagagagcatgatgccacaaagcttggcttgggctattccattttcaagagatacatgttaaagaagaggagggagtaacagcatgaagtagtctataaagtcttgatatgtaactctatgtcatgaaaaattataaatgctcccctaaatccgaagtataaaaggaggcaagcactcaaaaaggtgaagaagagaaatgagccatataaatcaatcccccagggcacaagagagattggcttattccaaagaactgaaatcccagtggctggaacatagtgagcgtaagagagtgactcaaaataaagcaggggaaaggtgggtgggggcaggccagagcagaccagccataaggagtgtagggcagaaaaaagtgcgcttttttttattattatttttcaattgcagtgggtggtcgtctatggaaagattttaagcaggaaaataagatcttgattgcattcatacatctaccacttgggcttctataagagacagcatgaaaacattgggaccagctctgaagctattattgcaaaagtccaatgaagagatgatgctcccttgaactagggtagggatggtttaaagtgatgagaaattgatacatttttagatctgttttgaaggtagaattgacaggattggtaaaagtttggatgagaatgtttaaagagagacagttatcaatactaacttctcaacatatggactgagtagctggatgaactttagtgccatttaggagaagtggacaattaagggtaaaacagttttaaaggaagctcaagaacttacttttgacctaattaaatgtgaagtgccatgtgccatctaaactgagatgcaaattttacagttgggtgagccccaaaagcctgattgggttagagatataaatgtgccaattattagcatattaatatatgagaattgataatatcatttgggggttgatgtaacagagaaacagcatctcaggaatgagctcttagaaactcaataggcgggacacgatgactcacgcctgtaatcccagcactttgggaggccaagacaggtggatcgcttgagcccaggagttcaagaccagccttggcaacatggtgagaccctatctctaccaaaaaaaaaaaaaaagcaaaaacaaaaactagctgggcatggtggtgcaaacctgtggtcccagctacttaggaggctgaggtgggaggatcacttgagcctgggatgtcaaggctgcaatgagccatgatcacactactgaattccagcctgagtgccagaaaccctgccaagaagaagaaggaggaggagtaagaggaggaggaggggtagagggagggggaggggaaaggaagggggagggggaaggggagaaggggggtggggggatgaggaattagtccgttctcacgctgctataaagaacttccctgagttcgttctcacactgctatgaagaacttccctgagattgagtaatttataaaggaaagaggtttaattgactcacagttgctcatggctggggaagcctctggaaatttacaatcatggcagaaggggaagcagatgccttcttcacaaggcggcaggagagagcatgtgaaggcagaattgtcaaacacttataaaaccattagatctcatgagaactcactattatgagaagtacatggaggaaactgtccccataatccaatcacctctcaccaggtccttccctcaacacttgggaattgtggggattacaattcaagatgagattcggacagggattcagagccaaactatattactcaataattcaatagagagagattagggttctcgtgttaaaatatttaataagtgtttggaaaaatatacataattgagggtaagtagagaaaaagtgtctgagagcatttggggggcaaacagatcatctgtgtggaggttaaaatgactgcttggatcctagagaatgacagaaagacttggagaatgaagagcaacttggcatccatgcacacatatacagtggatgtggtggtgccacagacgtatggcaaataatagccactagaatgcggggaacatggtatggccaggaataatgaaccttctaaggatgctgcatagacagcataggggagccatggattgagctacatcctaggcaattagggggtgttctaaatgacagagcatttcaagcactgcataggacaccagcaaaatcttccccaaaacggctgactcatgagctgagtgttgaagaacaagtgggtgttatgcggctgagaaatcaggagaaggaaaaataggtcaacttacaaaatgctttgtgtaggatgcaaagcagttgaaagtttgtcctgaggtgaaagcaagcaatggatggtttcaagcaaaagagtaatttaatcaggcattgtatattaaaaacatcactttgacagctgtgaataatattctccaaaggacacccagagataagacagggaaacaagttcgaaagcccccgtagtaatgcagaggttgaaaatggagacttaaagtagtggcaataaagtaaaagaggaggagattgatttgatgggtatttaagaagaggagttggccagaccgttcctgatgagacagagaaagttgaaaatggtaaccacatgacatggagcacagaggagcagaggaaaactaggaaaagggtaagattctatgttgctttgggtccctgtaattcaaccaggtaaagttgtcctacaggcagatgctacgcaaagtcactgtaggaccttgaacacattaaaaaaaaaatctttggccgggcacggcggctcatgcctgtaatcccagcactttgggaggccaaggtgggtggatcacctgaggtcaggagttggagaccagcctgaccaacatggcgaaaccccgtctctactaaaaatacaaaaattaactgggtgtggtggcgcacacctgtagtcccagctacacaggaggctgagacaggagagtcacttgaacccggggggcagaggttccagtgagccgagattgtgccactgcactgcagcctgggcaacacagcgagactccgtctcaaaaaataaataaatataaaataaaaaaatctttgtctcgggtttcttgtaaataaagttcagtaattggaataagttgatatcttcactgcctttccttcaaaaaaaaaaaggaaaatatttccattgttaccatgagacatgaaaaaaatcactgcttgcagtcaaataatttagacagaggcttcttatctcaaacaagcttgaatttactatttcttgctaagtttgacataaattgactcttcattttttatcgtaaggcagtagttctactatgtaattcttctgactgtctgcagctcagagctacatctcttggaaatttagaaattagggggtgtcctaaattatagagcatttcaagtgctgcacagttgatgacattgaggagagaagatttttcacagaatcctttgtagaaaaatttatcatcctgtgaaagccaaagcctggtttctttttttagatcttagggtacatgataaaatgtgatcattgttagcctcgccttccttctccatttttatgctccctctgaaaatttggtgttaaaacttttgtgaatataaactatcttatattttcagtatcaacctcttttaattgtatatttctaacatttcagcttttcatttccattttcttcaggtgttaccagcatcctctccctagataccctgaacctttgtatttaaaaggttctttctgctttcacttagttctttctgctagatgattaatagtaacaatagtaaataatgctcgatccagccattattcttgaaactttactgtctatccttaaacctaagacaatatttttcttcatcttctatcctctaactcattttctccataactccctttgcattcatttttttcttaatttaagcaagcatctgtgctctagtgcgtgaagtttaaagtccaaataaagtactcctcttgcattcttcctagccctggttttgtagttttatcaaaaagccattaagcttgtttacataatttgtgctttataaagccccaggatttagctgatcaaattctattatcctctctaatagtgaaagctgttcgtgtctttttaatctaatatttatagagagcttgtaacggaagtttctaagcgcttgcactcagtattagtatcgtatttagtattatgtttctcacaagttttacaagtacagtgtgggcaggaggaaatgggtcactgaggtggtggacttgggctccagtggagagtatcataaacccacccacctccacctccccctccccgtgtccacaaagcaaaacagtttctatcctatagtacagtcatgcaccacatagtatttcagtcaacaacagactacatctagaatggtggtcctataagattataatggtgtatgtttactgcaccttttctatgtgtagataggttatatacacagacaccattctgttacaattgtccacagtattcagtacagtaatatgctgtacaggtttgtagcctaggagcaataggctttaccgtacagcccaggtgtgtaatgggttatgccactgagatttgtgtaagtacactctatgaggtttacacaatgaccaaatcacctaatgacacatttctcagaacctatgcctgttattaagtgacacatgactgtactattttccttagcagtttacagtaatacaaatttagtatccacagtttctgtgtgtcaaggcacaggtgacctgggtcaactgctcagagtcttgccaggctgagaccaaggtgtcacccagggcttgggttttaccagagacttgggatcttcttggaagtttattcaagtgttgatagattcatttccttatggtttaaagactgacgtctcctattcttattgtctattggccccagattgctctcagctcccagaagctgctcccagctccctgccttgtggctctgcctgtccaggaggagctctctgactcgctttccagcgctgacctgacttggtcgtcactcaggataattacccatttgattaactcaaacccaccagtttacagcccttaattacacctgcaaaatctcttcatcttttccatgtaaagaagcccggtcccattagtgacaccccatcatatttgatggccccacccccagtctaggagagggtattatgcctggtgtacccaccaggtggctagaatcttgaagaccattttagaattctgtttagcatgcttacctatgtgcctctgtaaattattcataattccagcaacctttatttctaccttttgagtaacaacagtgccatatttagattataaaatcttaggctttactgttaatgctcttataattgtaacatattgttctgtaaaaactttgacaataaagataagcaaaaataaaaattgcttgtcaaccagaaatgacaattactaacacattagtcactgtgcaataaagattgtatattttatacaggtacctgcatacataattgagggcaaactaaatgccaggcacatttttaaaatatcacatgcattaactcatccaataactcatgacgacctcacaaggtgggtaatactattgttctcccattttttgatgatgaaactagagctcagagaacttaagtactgggccacacatgtagtaaataataaagcttgacttttcagccaggcttgtgtgttcagagctggtttgtagttaccgtgtgtatgtgtatgtgcacacacaagttcacacatatataggaacagcactcctcattttagattctgtagtacgatttgcaatatgattgctgaaatgagcattttttattcaaatctcttcattatcattgaaactttcttacacagctctgattcattatctgtggtttggacagcatttttgttataaacaatttacttcttaattatctaactaatgccttggggtttttaatcagaggacacattttaaatgaaatcgatatataaaccattataggcaattagtatgatttttagttcttttttttattattattatactttaagttttagggtacatgtgcacaatgtgcaggttagttacatatgtatacatgtgccatgttggtgtgctgcacccattaactcctcatttagcattaggtatatctcctaatgctatccctcccccctccccccaccccacaacagtccccagaagtgtgatgttccccttcctgtgtccatgtgttctcattgttcaattcccatctgatgagttcatttttaattcttaattcaactacaagtattttctctaatataattttctaagagctttacataatttgtatatttcctgtctacctaggtttatcatcccttaaggtttgagcccagctttcagaataacttaaactctatccccaacatctagttaatttttcaatgtaaagtcttaaactgaatctaacaaaatcttgtttgaatatgcaacaggattgaatggaattgtactggatatcatcggtaacaatgatcgtagtgtctcattcttccccttttagagaggaaatcatgtagaaatgaggacacacagagctctcctattctatattagggcttattaacattcataagttgggcgctactaagcttctaaccccttcattttcctttatatcataactatttctctgatgtgtatactggcttcctccattatattccctctactcatttttatttctttctcatcaaagccattttctctcctctttctgtctcctaacctagtttacctcctctatggttaacccactcagagaatagctgtcctttatgtcttctttcagacacatcttctcctctttgtcgacctctcacaggctgtctttgttataaacctttgtaatcactcagcaagtcctgcttcacgcattcagctatttcagttcttcacaatcagtataaatctttgaattcaattctgctcatacagcttcaattgaaaatctcggaaccaactcactgatcaaacacagcctgtaaagaactcttctccgtaacggattacccactcccaaagactcccttctggattcagcctcattccagagcttctgcctgccaggctttctttgcaatctcatcttcattgtgtgtcagccatagtgataggttaatactatagaagttctcaaatggttttcaaacttcaaattaaaaaaaaaaaagagaggaaaaccatgagatccagtgaggcctacaccacaggagaggacccagaaagggggtacaagaccccaggtgaaatcaagatgaagtggctttaggtatatcacaggtcactcagcccttctgaggtttccaaaatcgtactctctatgcaaatgctcttccttcaaatgttttcatgtaacctgacaaaacaatatcttatagacactgcttgattttgtgcttttaaaagcactgcctttcttatgcaatttctctgctcaaaatccgagaaagacttcacagtgtggatggctagggactgttgtttgattacctctggcacttggaatctgaaactcttgcctagtctacagtaatcaactattcaaacaggatgggaaacacacacacacacacacacacacacacacacatgttgggaaattcaattaagatcaactcatttctttgcaatcaaaaatcaaaaaccacaggaataatctcatacttttttttaactaggaatttctctcttccggctaaacttaaagccaataataactgtttctgtttctccaaactttaggtttttccaatttgtggatcaccttttatttcttctgaggatgtcaagtttcatatcagaatgtccctggaaattttagaaagaaaatctcatatagcagctaatctctctttttatcttgtgtctttgtccaatcaccacaaccaagaaagttaaatagtaaattgcaccaatattatatgttgcccaaactggaaaatatttaaagttttatttcctggacctgacttaaactagaggccctaaaacttttcagtgccccacataaatgattgctgcataaaagtacttgtctcattaatgaagaatgaaaatacaactttgggaaaaaatatccctgtggatgaagttgtcaaaaaatctgtttgctgcatttacgtacagacaatttcattagcattgaactcttcacataattattaatctcatgttcggtttttactcagatttctgaacaaaatcagcattaaaaagtgagattaggcaaaaacttgctgtatcattcacttcatcatcattactgttgttattcatgttttgcttttatgtgcatccatgttattctatcttcactggacccctatttgtccttctgtttctaagctcacttggtgtagctctaggtttcagggctaggacaaggcagcataattttgagagatgaaatgaatgcctttgctgctccaggcagcagggcatggaggacagagcgggaagtttgttagtacattgtagaatctgatatctttttgctctcaggttttaaaagactataaaataatattgagcatcttgctgacatttcactttgttctaacatgaagtgtttgctctctatatctggggtataccatcatcatggacttcatcttcaccatgtctgtgtttatttatccaagaatgtcttcatcccccctatattggaatgcatgatttttatataatgtcttcttcattttaattttaccctctaatgtggatatagcacatcccctggtagcttcttgatcctttagtacaacctacttcttctctgaaagttagaagaatcttgtttttgttccagatgttctgaaatttcaaaacaacgtgacttggaataggtcagttttcatgtatttgctgggtgttcactttaacattggcaactcatgttcttacatttctttttatttatctgtttgtgattctgtctcttatgatttatctattgtctctttctagaatgcttttcattgtggttttaaatcagagttcttttttcttcttgaaaatttccttttctaatggcgttctattactgctttatgaatgcaataccttttttgtatcccaaggataataaaacatctttttttcccttctttcttagttttctccaagttacttgattctgttcatttttttctgaccttcacagctttcctcatattcgtgattattattagctgtgtgtttattattacgagtgggagggtcttgttgacttggagctttactgtgggttagagtaacaattatgtcctggcttgctcagtacagtcccattttactcccattgccctgatgtccttgtgaatagctcttccttttattctcagtagtgtccttgtttggatgataaattatttgatcacctcactgcagaggaagctgagtgttcccgttttaggactctctcatctgttgtcagcattatttttttcattttctctttattagtcaggttctctaaggatacgttttaaaattctttcctggaggtttctgatctggttgccaacaatcttggaaccatttggggaaagaggtctaacagcatgaacattcagtatttggtacaagtgtaggcaatctccattttctgtgtagtttccacattctttgtaatacttggttcttctcaatgcagggattcttttagaaaataaacctccagttatctcccagagtgagagaggagtagtcaatcagccacaaggcttaggagacctagggatctactatctgtcaaacagccttaatgcagttctccttactttattaattactgaatcttttatggattcatggtcgaaagttgggttggttctcatctttccagactttcaagttaagattcagcattctactaagtcagtgagcacatattcatttactttccatcctccaaaattgtattgctagtattgattcatattctcccggtctttgtgggaaatgtgtgtgtgtgtgtgtgtgtgtgtgtgtgtgtgtgtgtgtgtgtattccctagctttaggagtatgcatatgtgtatgtgtgtgtgtgtgtgtgtattccctagctttaggagtatgcatatgtgtgtgtttgtgtgtgtgtgtgtgtattccctagctttaggagtacgcatatgtgtgtgtgtattccctagctttaggggtatatatatgtgtgtgtgtgtgtgtgtgagagactgtgtgtgtattccctagctttaggggtgtgtgtgtgtgtgtgtgtgtgtgtgtgtgtgtattccctagctttaggggtatatgtgtgtgtgtgagtgtgtgtattccctagctttaggggtgtatatatgtgtgtgtgtattccctagctttaggggtatacaactgtgtgtgtgtgtgtgtgtgtgtgtatgtgtgtgtgaattccctagctttaggggatttagaaggcatataagttaattgtcagtgtgccagtgtttactcaccatcctaaccaaggtgcagcttctttatttttaattctgtaatttaatgtcataaaaccaaatagttcaaatacatgtttcaaaacacgtattttaaaatgtatgaaaatctccaaattttaatgtaaattaataaattttcctttttggttaaggagtgtcataattcttaaagtgtttattattgattatctgctgtatgagaggtaatatgataaattctttcatctattgtgtttcatttattcttcacaataaccctgagaagtattagggtcccaattttgagatatggaaactgaaacacaaacagatattaacattctctgtaacacaatttacaaaaggctgtttacacaaagaatatagatttggatgacatcctgtatcatttagtggcataagtgtgtcactttcactttttaataggttgaaacattcgaagaaaccctcagttcttataataatataaattactattattattatttgaaaatttttttcttctctctatgatttctggttaactggattctagactgatcaagggccatgtctgtcttgtttactactgaacccagcagagtgtctggtatatgtcagcactactactgctgtgaatagacctcaccactgtgtctttttcagtagagctaagtagccaccaccaatctcagtgctaaataagaaaacaagtttgagataggtaagagtgtgcatcacttataattagaagacatgcgtttattagcaatatgctaaaaaaatcattcccacaatctgtcctataaacttgaaaaagtccaagtgctctatccttttaggtgctccaacttgtccttgtatggctgtttttacagtaaatatgaaaatattctagaagcaggattgagtttgccttatactgggatcaggtaactagagtcctctaatttaatgactgaaaaagatctatttaagaatcaggcctcagtcagcattatgaaaagtaaaaggtaaagagttcactagattctttcatcattttgatgcaagagtgaagagttactaaaatgttttagctaagcaacataggtgaacatcagtaatttcttccaccagtgaaaagtcaacttccataatgcaactaacaattaaatttatgtaacaaaatagcaggttttgagctatgataaatgcaacttatacgtttggggtagtatctacctctaaaatctgttcttttaatgaaatgctagccaacccccctatgaagtgtgggttttgttctcgcttagggtgactgaccagccttacaccaacccttggatatagagccatattgtctaatacacatgcaattatatctaaccatccttgggatgtattttaaaagtaaattacaaaccacatagcctatgagttgactatccaggtagttttaccaactgtttataaaagaaactatgtcaacataaagcagtcagtttggaaaacacgtgcaagagatggttactttcacgtgaccagcatgttgcttagttgtaacatgctataaagggttgtgttttactaacagtgtcactgatgatcctcggttcattcatcatacttctgcgtcactgctgctacttactaactacaatcccaggccagcttaagcattagttttctttacattttgctttgctcattgcttctttaatatatccttattaccatagtcttccctctgtgttctccagtagatagaagaagaggatttgacatgacgctaagcacattaatataatagtttcttctcccagtggtatttgcatttcaaagagaataacaacaagatgaaccaaaatatggaagcaatattttcagacaggataccttccattgctctctaaatcactcctatctgtagcccccattctacttgtgtatacaaaggcttgtagcccatgtaacgtttaaagtctctcccatgtagagtttcttctattggggtggcaggagggggctgaaatggcaagccactatttctattaactgctctgtcttttgcttcaatatctgtttcataacaagttttttttttctcaatagctaccccattttataggcaaaggctcagaggaaaatgagatcagagaaaaaaaatgagttaaatatcatctgcaaacaaatataaagcaacacaccatgcaagaaaggctcaccccctctggatagagaattctctcttggtatcgtgttggtgtcattgttctcaccacctctactctcctcaagtttatcttttctttgggagttccagattctatttattaagtatccagtatttccatacacagtattcatttttaatattgaaatcctaatctccattcctattgatatttgatagcaaaatgttccaacttctatacaacatttgagtacttccttcattgtggccgctttagaatctatctgtatgtaactatgggtaggcaaggaccaaacttgctcagaaagtttcatagatgctgcggttttatcattacattgcctatctgcatggtgatttttttaatcagttattataagcatgtttgatacttttgattgataatggaaagtaaaggaatgaaagttcagctaattaaaagagatgattagaaagaagttggctttgcaggagattggttgataaaacaactgatattttctttttcttgtttcaagccttgggcagaactcttatgaaagcatttagaatttagagggcttgtcatggccacactaagcatctgactcatctggttgctgcaatgtcattaaaatgaatttttggtgccggttcaatttgtctttggctctacagacatgaccttattcacattgattgctctcccattaacggtagtgtagtaaaggaaacgaaataagaatatagtgttcaaaagcaggtctacatgcaaagggtttctttaacagtattattatatcatgatgttttcagagatgtgaagtatatttattaagtatattcctagattataagaatgttgctttaaatgatatattaattttctaccatagtggaaaattatttagtatacagtataaatcattcctaaaataaaaaattatgggatttatataagcatgtcaatatcaacttttcatttagaaaactacaaaagaaaccatttatttaaacactttaaaaccctgtgtattacgaaattaaagtatcattttcaacagagatacaacttttccgtcttttgccttctctaagcttagaaaactcacaaagtttatgaactttaaatcaaaatcaatgtttcttagtttctcatcaatattattttaaaatattgaatatctttaataaatatggagaaaaaattaattcagaaatattcttgcaaattggtctcttttaacataatctttaagtcattgcttacacttcccagtcactttagtaaattcttaattgacgtggttccaaatctcttcctaattctggtcattatgttcttttttaaatgtaatgaactgtgtggtgtgattaacagcaagcttcatgccaagtacaatacagtggggttttatcagatagcagagagagggtgtgaatcgtttcccagacttatgaaatatctatgtttatcattctttgttatctcccaggtacagtttttagaattttaatgtgtttaaataagcttgcataattgttaatgtatttacttaaccaatatttatgagtgcatcttatgtttcaggcataggtacacagtgacaaacacacataaaatctgattgtgtggaacttataatgttataagtatgtataaaattatttcaaataatctgttataatatgccagtgatacagttgttgctgtcagagacattgaattattgaaaaatgagaaaagtttacattattaatatgccatttatagccaatttctgatagatagttaattaccttaagaaagcaattctcaaactttagtgatttgtgcattgtcttcagaagtttcaccaagccccagaccacctatttaattatttaataaatatgtttttaatggactccctttttaaaatcttattctcattctaagcaacaatttccatgaaaggttgtgtttagttcacttgacattgcttcctactgtgctgtcagaacatcatattgtttagatatatcataatgcaatatcatatgaaatgatatttcacaaaccatcaatggtacatacacttgggaaattctggcttaactaaatccttgtacctaatttaataggtacttttctccaaaactattaacttgtatgaccttagaccaagaattgtgactagtacaattcacaaattgtcaaaattgaataccttatctaaatgcaaagaagtcttcagcataactttattttaaaacacagatgttgtgatttgatagtaaattattcaactggattctaatgagttatttgctgactgttcatgcatgttgacccaagtactcttcattcccacatctgtcctttagacagtctcctttttctgtccttccaactataactctgatttaatatttaatgaacaattactatgttttatattccttccctcaaagaagacaagctgtcccaagacattctaaaatgaccactcctcccacccctgtgagttctctgtgcaaccctgccgtccctggcctctccttctgtctctcaccttaccaagctcttagtcctaagtttcaggtaatggctattacaccctcactgaattttgagctgaagagaatattaattacctagtcacatctagttttacagatgaaaaaattgagacttatgttttgacagtccatacttaaatgctgaaattttttttaattgggttcagcatcttcacagaattaaccccaatcatgacagttcgaacatttcctgaaaacaccttgtattgctgtctatttccatcggtttgcaaaatgatgttgatcttgttttttacattatcattttttttttttttgagacggaatcttgctctgttgcccaggctgaagtgcaatggcacgatctctgctcactgcaaccttcgcctcccaggttcaagcgattctcctgcttcagcctcctgagtagctaggactacaggcatgtgccaccgtgcccagctaatttttgtatttttagcagaggcagggtttcagcatgttgaccaggctggtctcgaacttctgacctcagatgatccgcccgtctcagcctcccaaagtgctgggattacaggcgtgagccagtgcgctcagcccattatttgtttatctaatagcttaatcattcatcactgacattttgagcatttaaacaacatcatcctcaataaagttctagaatttctccaacgctgtgttctagacatggcacttcatgtgaacaattccacaggaagtaggtggtactattactattcgcttttatatgtgaggcagccaaatcataggtagataactggcctagagtcaaccattattaagcaggagagtggaaactagctttgtgtgatgttggagatcaccatttttgtcacttcattataatatccactttattccaggtgccattctagaggtataagatactgtataaatttataagacacaaattatatttttaacagatctttggtctagtttaaaagacagaagtaaaagtatttattcaccagatttacatacaagtaattttgggctattgtcacaattcaaatctaccttcataggagaaacattcatgattatggatatacatggaaccatgctgtatagacaattccaatcaaaatgctccacattgctttggacaatgtcaggatcactggaataagtacatagcatggcaaaatgagttttgtgttgtttttcctcctggaaataaagccaatataagacccctggtcaaccaagagaaaagcccataaaggcaggttccagtagctcagagtaagtgtataggatttcttgtgacaaaagcattgtgacatattatcagtgaatttcccttctcccatccaaatctggtgattagtcattaactccagcttaacagcaactcagcagtaacaacatgtactcggtttagttatctgaaataaaacaacaacaaaatgtttctagtggtatgactgttgtaaaaatatacattatatacaaagcagagaacttatacatagtaggagtttgctaaataaatatttctaattgattaaagaaaatacaatagtaagggcctgcctatttatacatataaataatttgagttatggaatgtaatgtgagattatataattttttctccttgtgctgtaagatatgaacaaagagattttagaagaaaaagatataaagaattgtatcacttattaaaaacttagtttattgaagttctttaagagacattgtacttttaaagaattttcataatagcctcaagtttcaaacaagtgaatgtctgtaattgacagccaactctaatgagagttgtggtgttggaaattagcttagtatcttcaattctttaccctgaactggtttacactggcacttgtagattgcatgttcttattggaggtgacattgagagattacattaagttggttatcgatcatactgtataggttcactttactaaaatgtaatctctgtttcaacaaatctaaatctgacaaaatatgccatttttatgccttatggactcagaggttataagggggatgagaggcaggttgcagccccaaactctgggcatttcaaatctagcccagagtgttatttattaaatcaaatgatacatatgaaaatgtttcctatatttaatatgcagatatgaaactatagtactttaaaaagtacaaaacaagtgtcattgaatactttctatctacaaaacattctggagagtatttgaatgaataaatcaattccctccagatatttagtagtaaagaaattctttatgccaatagtgatttatctatcctaattatcataacagaagtaaaacaaaatagtgaatatatttattttattatttctagcttatcttattaattgtgtcagcttcttttcctatttttcctcgtatgagttaatctggtcttattctttctgaactaaccatatcctaccctgactttaccaaacatacaaaagtaactatagccaaagctactaatattaatctggacttccttatgcaaaacaatgttcacattcatttaactgcggactctaatccccagagcctatttaatcattattgtgatatcgtttttgttacttcaaacatttggcatgcaggcagaaacatgtatatgtgtattcctgggaaatctatcaagcagattcccaggaagtctcctaaggtgatattgattacattcataatattattattgttcagagaccttgttgaaaaccaagaggtggtgaaagcctaagcgaatgacccattaaataaaactcagtagactgatgtatacaactaaaaagccaattaatttaatttatgagaaataattatctagaaaccctgaaactcaaaattataactactgcatcctctctctatggcagttccacataatcagctccatttgggggcttagaatcagcatgaaaggaattacataaatcacatgaattgatgacatacggctaagcctgtttgttgcattattttgctacttcagtctgctggataaaattcctctccattggatagtgctttgacaatcaccaaccacttctgctcctacaactctattttttttccaaacttttaaaatggaacaaataccattctgctcatttcttatatatatatataaaagacatgacatatatatatatatatatatatatatataatgtcaaacagattaaaattagttctttctgacttacaaatcaatccatctcatataggttagtttacatttttctattctgatccatgtaccaattttaaagtttaactctttgcagataattgtattcctcacatgtccacattgtggggacaccaaagtactcacagcatattctctaaggggagatgtctataagtcaacattataaaatatgaacattatgtttactgtcagtgtctcagttaacaaaataattcattgattctcagatccatatgatttttcacaatttcaacatctctgaaatcagcatgtgtcttactatcggtagcatctcacaatctctattggccaagccgagacggtggcatgggtgtctcttcctgtggacatgtggcacttgtatcaaaacttgaagaataggcctcagtgccttagaggaaagttctggagacaatagaggctcaacctttttaagaactctgtcaccaatgcttttgtagacagagagaaccattcagagggcacatcagtgattcaagccgcaaagtgtttcaagagcgttagactatgaaagagaagaaatttggggaatggctcaaccaagtcatgtcacttatgttttccttttcaagtatgcacaaaagtgatataatttttaaaagattagaagagctcttttgagatgcttcattttctctttcttaggggttcacgatagagtggtgtatcttacaatccatggcctcctaattatgaaatataacaatgcatactttcaagtaatattccatctgtatacatttattagacattttagaaatactaggagcagaaatcaacatctttttcaaggcgggcaaatctttatttactcctttgtaaaggatcattttagaaagtcatttccttattctgaaatatgtagtggataaatttaagtaatattttcaaattctgtcctaatagcaaatggaaaaattaaagctgttgattcatgaagtatgatgatctattctattaccacagagtcaaagccattacatggtttgcctgtgaaaaaatagtagagaatacaaatttgtgtagataagatatgggaagaaaatgtcatgtttaaatctgtaaatggaattccctggaaaagggttagcagcaccactattaccgatgtgaaaaattcagagcttcttgcctcttcctctctgatccagagatgctgctgagaaagaaacagctctgttttgaagaggctacagcaggcaggcatcttcatgcttacacaggcctctctctgctgaggtggcctcttggggaagcctcacaaaaactccctatcctcagctcccaggatcaggggagaaggatgcccttgatggcctgcggagatcttgagacaaggcatgcggccaggacagacgttgattggcatgaccctcagtgagaatctcagtgaccttcctaggacctcctgggtctgctagggcacatcagtctctgagtctctgtgttgcccacagccttctgtctgcactttcctatttgacagaaacagcttcataaaagcagttcccataaattgaattcccgtggcttgacctaatttactatctccatatgtcggttccaaatcagcagcaggcatatttacagacctgggttggttggcttacccaattaaagatgttaagtaattaaagtgtattactttttcaagtatggagtattatttttcaaataatgcagtatatccttatatactgcactatttaatatgctgttctaatttaaaaaacaataaatatcattactatgagttaggaataaaataactggtgagttatatatatacaaatttatatgtatatttgatataaaattatatataaatataaatacatttacattgtatacaattatatatgtgtaaataatatttattatctcattatagatatatagatctattaatatatagatagatgatatatatagatctatatatatgatatcaatatatgtgtatagctatagatgatattaatgtggaatcacaactagaaataaatagtaggcaaaggtaattttgaggccaaaaatataaatacttataatctctcacctttaattaattcagattttaaataattgaccaacttattttaaattattttctatggaatttctgtggtgttttacctctctaaaagtgtgtgtgtgtctgtttgtgtgtatatatatgtgtgtgtgtgtgtatatatgtgtgtgtgtatatatatctacatatgtatgtgtttatatataatactttataggctatatgtcagtaaaatatttgaaaagttttattctgagccaaatatgagtgaccaatggcccatgcatgatacggcccttgggagatcctgagaatatgtgcccaacttggttttacacattttagggagatttaaaacttcaatcaatacatgtaagatgtacattggttcagtctggaaaggtgaaactgaagcaggaaggagttagggggcaggggcttccaggttataggtaaattaaaagattttctgattggcaattgattgaaagagtttaattatggtctaaagacatagaatcaagagaaagcaatgtctgggttacgttaaggggttgtggagacaaaggttttattatgcagatgaagcctccaggtaacaggcttcagagaaaagtttgcaaatgtttcttaacaggcttaaagaatccattctatcagtcttaaggtctgtgttgatgttaatgctggtcagctgggcctgaatttcaaaagaaaggagggtataaggaggcttatctgactcttcctttctatcagggtctgaactagcttttcaggttaactttaaaatgcccttggccaagaggtggggtccattcagttggctgaggggcttagaagtttatttttagtttacatagatacacacacacccacagagagagaagaggaaggaaggaaggaaggaagggagggagggagggagggagggagggagggagggaaagaggaaaggagggagaaaaggagggaatgggagggtaaagaatgaggcagaaacaaaacggaaatacccttcacagctaacctgtgcatttgtgctgccattgggcttgtcattagttgtgttggttgttccttgcacaagggcagccagactagtgagtcagggctgaaatcagttcctgttccacttggaaaccacatgctctggcacccatctgcatttgtggggaaagtgacacctttttctaattcatgcaaagacaccatatgggctacctgtggcctggcaacagagtctaccacttatacccacagaagattaagcatttgtgctcatcattaccctttccagccactgtcttttaaaatctagtgacacttcagtgcaaagttgtttaactgataccttgtttttggtgaattgagtagatactggcaacctaacaaaccacgagaatttggacagaggcatccccaaaaaagcagtgaggaaaggaagtgtttgcagctaaaatacatttaattacatcctgggaccacttcaacatcttaagcatgtggaccacagctacctcttcattaggtgttgctctctatttgatttacagaatgcagggtcagcacttgtgaattagcgtcgtgaataagacattcataaaaccttatcagttcagaaccgatgctaagacaagacgcaggtctagagctcataagactggtgacaatttcacttatttatgtcagagaaatgttacacctgtgtttttatagcataaagttggtgagccttcctctgtgcaaacctcataagccagacaacacatgcaattaattgacagagacaagagaatccccatttctgttttctgcatggctgctttgcttacatttcagcatactttacctcagttttatttttgaacttgatctagtttggattttgtacacccctaaaaattacctaaactcaattgtaacactagactgctgctgaacgtcatgcttatagagttggaagtgttctgttgaaggatcatttatccaaaagcaacagcaaagatttatcgatacctagtaaaattctgccattccatccttcactgtccagctcccttctgaagatcggatattcttttaaaggcaaataagacgcatagtggtattttacttggaaccttatgagagagaactcaatatatttgaagaccctggcatttgtttttaaaaatactttattgtgtgtgttttttctttccccatcatagcattgttaggggagaaaattgcattatttaaaagtatattatgttagaagccagaagtcttgagctatatttctctgctgtctgtataaccctgagtccatggacaaataaatttgctttcctgagcctttgttttcctgtttagaaaatgagacaattgatctagataaaatttaagctcccatccaatcataaatgttccataatactaatgtagaaaaagcaggttactcagaactatttctgaatccaaaaagatagatagatagataaagctactttataaattatgaattttttttgtagagtctgagactttatgtaaaagagaaagagagatggacatacagagagagagaaaaaacaaaacaaaacgaaacaaaaaacagagaaagaggtgctggatatatttggaccctcctttgtgagaagggaaaagatgatcccaggagaagatgggatcatctcatccaagaaaagatgatcagctagaaccagattgctggggtagtctagaacaaacatttcaaaagaggttcactactttatgaggagacagttctcaaacaagaggatactctgtgaatagatgtattagaatttatcaacagaagcactctttcttcaccccttccagctatagtaccctgaatattttgatattttaatgcaaaagaagacatatttccctaggttttaatttttgactacccaagaaaattatcaacctgtaaattgcttttttctctatattgatataataattagaaccaagctaatcagatgtgccattatgttctttccttcacatcatagtgccaggcaacattgaggggacagctggccagcctgatgccaaaagagaggcatctaagcctcttcaggcaactgacatttataggaattatggtatagcatcaataattcacacaacctcacaacaagtgctggtaagcagctggtctgtagacaggggcctcatcacttactcatgtttgagacatttatactggttcattgccttaccttaaggcttctttaattgtagggaccacgaaaagaatgcagcaactagcaattaaagcaaaagtgctgctctgcattataagggtatatgttgattacttcatggagagggtgattggcttttgaaaccctaagtgaatgtttggtcacaaaaatctaacattttaaatgatcaatttatttctgtttatcatttccttgagctgtgaattgaaaagaaaaaaactctaccacttattttatagaatcttagacatttagtattgaatgtttccttagaaatgatccaattctttattttgtttaaaaaacaaagatctagagaactaaagtaactttcctcaaatcagacagctggttagtaaaagttttaagactagaactcaagtttggtgaaaatgtttcccctaactgacctttgcatgcacaaagttcgactgattataatccttggcttgggacagactgtcattattcatcaataacttatcaacttttattttacaataatataataaaggcttatggacccagcagccctccaaacagcaaggagcatgtcaataatatgctgaacttatggtccttctcattcccctttccttctccctttgctacctagaagtaaccagcaacctgaatcctgcattttcttgatgtactttgcatagttttatggcatgtaaatgtatgtcttaaaaatatatttttaatttataaaatgtgtatcatgctgtatataacatgacataatattgccaagactcatccatattgttgtatatgcctgtatcatagtgtatttttcactctcccattaataagcttttggattctctctaagttttttccattgtgaacagtgctgctatgaatattcttgtaaatgtcacctattccaaaggtgcatgagtatcccaggggtatatacttagcaagaatttcttggtataacactatacagttattcagtttcagaaattagtgacaaactatgtcccaaaggggtggcaccaatatggactttcaccagcagcgtggaagatcctgtagattgtatctatctggcttttactgtagagggccatacagtcattattgttggctctatgggcctcatatggtttctttggcagctactgaactctgtcattgtaggtaaaagtagccacaggtaacacataaatgagtttcataaattttcacagtataaaatattgttcttctgcttctttccaaccatttaaaagtgtaaaaaacataatttgtgagtcacacaaaaacaggtggcagactgattactttttctttcctcatcctatcttcttttatttattttttatttatttaaaaaaattattgatagcctgttacatgccataacccgttccaaattgatatggtttggctctgtgtccccacccaaatctcatgttgaattgtaataatcccaatgcatcaagggcggaagcaggtggagataattgaatcatgggggcagtttcccccatgctgttcttgtgacagtgagttctcacaagatctgatggtctttataaggagcttcccccttcgcttagcactcattctctctcctgctgccctgtgaagaggtgccttccgccatgattataagtttcctgaggcctccctggccatgcggaatggtgagtcaattaagcctcttttcttcataaattacccagtctgttatttctttacagcagcatgagaacggactaatatacaaatactgaggattctgtccgtgaacaacttataactttcctgctctcacagagtttgaactctaatcagaagaggcagaacatagacaaatgtatatattctaagcaagtcatgataggtattttaaaggcagattcagagaagtagatgctggtggtaggaggtaatagtttacatagaatgatgaggaaagccctgtttgatagaacaacacaagttgagttcatttttaaatgagggattggaacatccaagtatctgaggagaaactactgagtgagagagagcagcaaacctctacacctcctcccctgagcttttatggttctaatagcatgctgatatctcttcccaaatattccacaagctcctttaagtcttcatttgccaatctaaatttatcatctactacagccttggatttcctaacttggtgaagggcacctgtgtgaactcatcactcaaaccaaaacccttcaaattttcctgcatcttaggttgccttttactccaagcatcaatttactaaacaagtaatttcattttttcccttagtatctgtattagtttcctagggctgccataacaaaataccatggactgggtagcttaaacaatagaaatgtattttctcaacttctggagtctaggatcaaggtgtctgtaggtttatttttttgtctgtggcctttctccttggcagatgacagctttctctttgtgttttcaaatggtctttcctcatttcctcttcttgtgaagacatcagttggattagatgaaggctcaccttcctggcctcattttagctttatgtcctctttaaaggtcctatctccaaatatcgtcaaattctaaagcactggggattaagacttccacatataaattttgagaggacacaattcagcacatgagtatcttctaatctaatacctttcctctgcttttattgctaccaccttaccatttccttcccttttttatttatgtttattggttttctgattctagattatactcttaatgatcaattgtccccaaaaccagcagaatagtcctacaaaaataaaaatgtgatcttattttattctgcttgaatctttgatttgttccccagtagccttcaggataatgtccactggcatactgtatcctcaaagaactgcaccatctgcatccctgttcttcctctcaccaggtaaactctcatgctgtcagctacaacaatagtaaactatttgcagttcagggcctttacaaattttctttgcctgaaatttcatctctgccttaatccagtctttttaagtgacagattaatatattccaagaagcatggctcaatgtcatctatgaaaaacattagcataccatcattttcaccattgtctgagttagctgttcttcctctgtctcccaggtcatgatatctttcatatcactgacattgtataggataattatttctgccttggactaagtgcctgtgaacagggactgtgtcctgatttattcttacatctttagtgcctagcaaagggctgctcctcttaggcacttagtaaatatttgttacatgagtgaatgaataaatatataaaggaataaaaatgattagatagaagaaacatttttgtatattattttgatactctaaagctaatattctaatggtaatcaatatagtttaaaaataaaccattcaattttactaaacaaaatggtgaactataattggattacatggtataattatgacaatatgcatataaaaattaaaagcctacatagcaaattaatacaccaataattactaaaaataatacactaataattaaaagtggttgtttctggttttttttttttgcaaatgattaagctgtacacaatttattctttttttatacttttctgtatttttcaaataaacttgattctatgaaatatcccatgacccaattcatgttaagcaaatttactacccttttctcaacatcttcaaactgttttctttacatttcactgtttagaaaatataaaatgatatctgcaacaaattacattctgctacaaatccacattttcacgacaagaacaaaaaaatgcataacaaggcatagaggataaatttctctccaacccactgtgaaattttcattaagcccctcatatcttctccaggtctaggccctaaggacaaatgaagagtctaatctttgatcaaggcttacttcaagccaaaattatctattgctctagagaaactcttccaaatggtcataccctgctgctatgaaggtgacagtcctccccactgctcacatattgcatagctgcaggatgcgaggcaaagacttgaaaaacaagattaaaccttactcaaaacattatttccattaaaattacatcacaccgaatatcattacctaaatatttttatctttctgtaactcttacaaaacaaacattacccttgaggcaaccttgcagaataactttcacttaggagaaatgaaaaaggaacagacattataattgtagggaaagaataaaacaataatggtgcactttcttaagaccttcccttatttttttttttttcatttgctgattatccctttggccaaatagtagaactgtggaggttcagagatggaaggaaccttactgatcatctagtatgtatagcataatttacagttgtggaaatttaaagcccagataagccaaggaacttggttaatgtactgattcttcttcctctgggaaacctaggaaatgaattggatgataagtgacatggctctgttattaatttcagccatgtgattgatttcacaggttcttcagttaaaaagacttgggttctgtcccccttttaccacttaccatctgtttaaccttgggtagattatttaggcctttaaaaacctccatttcctcagttgtaaaatatcaattttagaggacctatcatgtaaagaggtgttaggattaaatgacaaattgcttagaactgtacttgggatcatagttggctactactattgttgttgtcatttatcctacaggtaatcctactgtttgagataaggcattctgggagacaagatttaagagcttttgaagaagacaactttatcacatttgcttcagactgtttagtgtgtgtccagcttcaatatctctctgtttcttagacattttaaagactgttaaaggaggagaaaggccagattacaacaattgttgacatttagtgaaggcttagtataaaacaggctctctcctaagtgaattttgtgtagtaacccatttattcctgaaaacagcttcacgaagtaggcaggcactgttctaatatctgctttgaagatgaagagacagacgcaggggttggtttcaacatgtgaaagtatattttattatcacctcccacattcacttctgcaattccaacatttgcaaggcaagagaggatttgccaccctctggtgtctctttttttttttttttttttgagatggagtctcgctccagtcaccaggctggagtacagtggcccagtctcggctcactgcaatctccacttcccgggttaagcgactaccctgcatcagcctccccagtagctgggaccacaggcgcgcaccaccatgcccagctaccctctggtatcttgggtttgatcttctgcttcgggctgtggcttcaggagctggcagtggcttgcgtggtggcaggagaagttcccaccagtcctctggctgtcataacatgcatttcatagctctcaccatatgtaacagtgagcaagtttttatttatcaaaaaggtagcctttgatgaggggcttgactacctgcttatgaattaacaaatagcagatataaagatttctaagtcatgctcttagggcaagaaaatgctttgaaatactatctgatctgcttattttctgggttttcgccttctccaccccttccaagtcaaggtctgagtctgagttctattggatattcactacaactgagagttattattgttctcagctttgagccttaaactaggcttttagaaactctaagcaagatagcagttttaaagggaagaatttttcctgaatgactaaattaggttttatcatagtcaaaagcatagattaaccaaggcaagctctaaagtaagaagcaatatggtaaaaagagagcatggtaaaaacaaagttcttatcacatcttaaatagaaaggcctttctattaatggtatacaagagagaaagcggaaggagagagagaagagatgggagaggagataggaagagaaaggggtagaatgaaggaaaaaaagaagaaataaaattgctgtgaaaggagagcaaaggatagcagagagaggaacaaagcaaaaccagacttccctcctcccctcactttctgcttggtgcccaaatccagagcagaggcagaatgcagagatacccagattgttttcagggaactaagatagggagacacataaggatcatctccttcaataaaaagagcgttgatgtcctcataaattttctctattcttaatgtgtcactctcctctaacagccatagtcagtaaactttttatgaattcccttcttagctttgtgactcatgtctagatttagtagccctgatctctgtttatcatcccttaaccttagcattcaaatgattcaccaatttatgcatgcaattgtattgtgatgccttattttccaatctccaaagaagtgtcatttgggaaatattgtacaggtctggatataaatgttactctatccaacatgtaactcatatttacaaattgaaaaagtttcagaatttttatggggacatttaaaaacgttaggtggcttaaaatattccctactgatgtacatcatctcatttgaaataatgtattcgatggaagcaaatgatctagtgaagagtattcttcatcttgctttccataataacttacggccgtatctcagttctcaaaatgcttttccaattacagctagcacttgatcatttgcgtgcacagcactttacctgaacgattgttgtggcacttttacctttctaccttgccacctgtcctgagaccctcctcagaaatcgtagttgctgagtctggagtagagaggttggtgactatgcagtaaggatacactgtgtctaacttagaatcttacaagatgtcactgacctccatctcctttgaagactctccgtgacctctaaaagttggagttcctgaggccttaccctgggctttcttctctttgcttgacgtataaatgttttgtttttgtttttgattttttgttttttttggcagtcatctcttccatttccatggcactaaatgccgtcttcatgctgcagctccaacatctgttaagctccagatgtttatatcttgttgtttaccaggcgtcagcatttaactgtctctcaggcatccccaatctgacttgttaaaaatgaaacttttgatccctccaccaggaaaatgtgttctttcattattcatttagacaaaaaactggcagtcatcatacacactcgtctctctttctctccttttctttttctcactctcttttactacctgccatatccaacccaccaataacttctattttttaaatttctgtcaaatatatgttaaacttattgaccttacatccactgccatcaccctgattgtagctactgtcacctccattcagggctacaagatcttctacccctacctaccccaatccattctccatgtaacagacagagtgatcttttaaaaacagaaattcgattgttttgcttccctgcttaaaacctgtcggtgcttcctatcattctttgtgttaggtatccacactccttctcggggtctcaaaccttgtgcagaatggcttcttgctaacctcagcctgagccccatctcattcattcagccttttgttttttctggaactcaccaagttgtttctcctcttacaacctttgtgtcagaggcattcaaaccagagcaactccatcttgaataagagctgggtgaaataaggctgagacctactgagctgcattcctggacatccttaggcattctaagtcacaggatggaataggaggttggcacaagatacaggtcataaagactttgctgataaaacaggttgcagtaaagaagctggccaagacccaccaaaaccaagatgcaatgggagtgacctctagtcgtcttcattgctacgctccctccagagtcatgacaatttacaaatgccatggcaatgtcaggaagttaccctatatggtctaaagaagggaggagtcctcagttccagggaattgcccacccctttcccagaaaactcatgaatagtctaccccttgtttagcatataatcaagaaataaccataaaaatgggcaaccatcagccctcagggctgctctccctatggagtagccatttttttatgcctttactttcttaataaaattgctttcactttactccatggacttgctctgagttctttcttgtgcgagatccaagaatcctctcttggggtctggattgggatccctttccagtaacatttgtaccatctcttccttctatctagaactttcccctgtcccacctacccatgcccctcactcccaacccagccttatcctccatcacttactttttgatcttttaggaccagttcaaatatcaattgttttgacacggtccatgttcaccctaaggagatccttcctgttggtattttttactaaaatctatttatttcctgaaaattacccatcctattgaattcttatttagtctctttccctgtttcatcttttaagatattctttgaaggtcaagtccatgtctgttttattcaccactaacaagccccattacctgggcccatggtaagcagcttattgaatgaatgaatgaatgaatttcccaccaataacatgtgagttagataggaactacctcaagctcatctcagagaagtgctttttcacatgtctaaatcccccatccttcagccccttcatcacttttcttaaaaagcacttggggctggttgcgagtaagagtgggaaattcaaatttgcaaagttagttcctgatagttcggaaacgtgtgtcctggggatccaatcatatgatcatttgttctgcttcaggttctttgctagccacccatatcctgctccagtcaattcgcaccctttagttcccaagggcgtaggtcagaaacaatgctcagtactttcaatcctggcattgccagcagcaataggtcaggcaaacactggggttgctgggaccacttagaatgtggaatgggaaggagcagttctaagatcattaatggtttcagcatagaaaaacaaaagtccagagacctgccaaacccctgtggggtaattgtggttctgtaagaacttggcctctgagttcggcattgcctgtaattacagcctttctttctttctttttttttttttctactttaagttctggaatacatgtgcagaacgtgcaggtttgctacataggtatacatgtgccatggtggtttgttgtacctatcaactcgtcatctaggttttaaatcccgcatgtattaggtatttgtcctaatgctgtctctccccttgcccccgaccccgcaacaggccctggtgtgtgatgttcccttccctgtgtccatgtgttctcattgttcaactcccacttacgagtgagaacatacagtgtttggttttctgttcctgtgttagtttgctgagaatgatggtttccagcttcatccatgtccctgcaaaggacatgaactcattcttttttatggctgcatagtattctatggtgaaattacagcctttctattcagcatcctcatttgtaagcctctgaaatgtctgagattatgattatcagtgcataagccctacactgtgagcttactaagaatattttcttatgtctgctatcattgggtgatatggtttggctgtgtccccacccaaatctcatcttgaattgtagttcccataatctccacatgtcatgggaggtacctagtgggagttaattgaatcatgggggcggttaccctcatgctattcttgtgatagtgagtgagttctcatgagagctgatggttttataaggggcttttccccctttgcttggcactgctccctcctgccaccatgtggagaaggacatgtttgcttccccttctgtgatgattataagtttcctgaggcctccccagccatgctgaactgtgagtcagttaaacctctttccttataaattacccagactcaggtaagtcttcattagcagctcgagaatgaactaatacattgggctaaaataaactgtcccaatatataaggaccacgttgtaaaaacttctccactgcttccgtcttttgcctagaacatagaacaggggttaaacgcttccatggtgtgtaaagttgagtgatagattaaaatgtaccattggtcaagagcagtagctcacacctgtaatcctagcagtttgggaggccaaggtgggtcaatcctctgagatcaggagttcgtgaccagcgtgaccaacatggagaaaccctgtctctactaaaaaaataaaataaaaattaaaaaaaaaaattagccggcatggtgtaatcccagctactcgggaggctgaggcaggagaatcactttaacccaggaggtggaggttgcggtaagccaagatggcaccattgcactccagcctgggcaacgagtgaaactctgtctcaaaaaaaaaaaaaaaaaaaaaaaataccatgaactaggtgacaaaataacagaaatttatcctctcatagttctggggagccagaattctgaaataatgatgtccacagggccatgctctttctgaagtttctggggaaaaaaatctttccttgcctcttccagcttctggtggttgcaatccttgagttctttggcatgtcactgcatccctcccgtctctgtcttgtcatcacatggtattctccatgtgtgtgtccatgttcagatccccttttcctatgaggataccagtcattggattaaggctcattcttactctaacatgttatcttaatttgattacatctgcaaagacgctatttccaaataagatcacattcacagtttccaggtggacatgatttggggatgatactattcaatgcagtgtatgagggttcacttgtattcagttatatcaggtaataccattaagtgtttcttaagcttttaatatttgaaaacaaccttattcacaataattgataaaataactacatttcagaatttaaatatacctgaacaagaaatgacaaatggttgtcaagtacttttatgcttagaataccatgctttcctcatgcaggaaattggaacagaccctggtcatgggcgtgttaaatcctcctctttcatccaccactgatctgtctcataacttgatcactcctatggaactgactgtcatttctcagtttcattctaggaggcttaaaagttctacagagcaaaagtatttttcttcctctttttgcttttttgcttgttacttttgttgaggggtcagcaaatgtcctctgaagagccagatggtaaataatattagtaacattaggctttgtgggcctcacggtctctaccacaactattcaactctgcctttgtagtgcaatggcagccagagataacctgtaaacaaatcagcatgcccaagttccaataaaactttatggacactgacatgtgcattttatataattttcatgtattgtgaaatattattcttcctttgatttcccatccatttaaacctgtgaaaagcattcttagctggaagactgggccaagaagaggtgggccagaatttgttttctgatttctgccaagtcttgttccctctctcttgttggttgtctgcctttgctccaccttttctggcatagaggacattctgcagggtactgtgtttcatatcctttttttcctttcccttctcctcctgcctttgaccttccctttccttttcttccttccccctcctactactatgtccctaaaataaatattcactacccctaaactatatttgatcattgcacattgattactgtaatcatttcctattttctaaaaatttgatgagtgtgatgtaggtcatggtgataacatgagggtagtcattctcttatttagaggtagaaattagatttaaatttctggcataatataagtatgaattgtaataatcccctgaacattattagaaatgtagattttttctcttctgagtgatcagcctccaaacatatccaaaattggagagagcactgtaaaagtcctgtgtccccgttactcagcctcaacaggtttccattcacagccaatgttgttttatttgtacctctgtctcctccctcctgtgaaattattttgaagcaaattccagacatcagtattttcactggcgtccctgtgaagagaccaccaaacaggctttgtgtgagcagcaaggctgtttatttcacccgggtgcaggcgggctgagtctgaaaagagccagcaaagggagatggggtggggccgttttataggatttgggtaggtagtggaaaattacagtcaaagggggttgttctctggcgggcaggggtgggggacacaaggtgctcagtgggggagcttttgagccaggatgagctaggagaaggaatttcacaaggtaatgtcatcagttaaggaatgaacaggccattttcacgtcttttgtgattcttcagttacttcaggccatctggatgtatacgtgcaggtcacaggtgatatgatggcttagcttgggctcagaggcctgacaagtatattttagtatgtatctcttaaagacattgactcttaaaaaaaaatatatatatatatatatatatatatatatacacaccatcatagtaacatatctagaaacaattaatacaaatttcttaatgtctttaaatatccagtgtttacatttccctaattgtcctgtaatttttttatgtacaatcggattgaattgtaacctacaaactgattagttgatctacttcttaagtctcttaatttttagattcaatctttttctgtctctctttctttctctgtttctcttccccctattttaagtttatttgtaaaagaaagtaagtcttccgcctgtggtgtttcctacagtcttgttaactgatatcttcccagtggtatggtctagagatttgaggaaatttatgttgtatttgtttgttaataatattttataattgttgcagtatccttccatcaagaggtccaaatgtctacttgtcgttcttttgtggtgttagcagccatggatgaccattagtgtaattattagcagttgcaaaatcatgatgttcttcatacagttggggtatttatcccttaaaaaaaaatgctacctgttgaactagatgattatcctgcatttttataggaattataggacaagtgtttatttttttctttaataagatttcaaaataaatttgttttctagtattctccaaaggcaatcaatgaaacctaatgtttgtttattaggcattatgtacttcagtctattttttttttttttttactttaagaacatattttatttaacccaatatatccaaaatattaccacatcaatgggcaattaatataaaagtttattaatgggatattttacattcatcagttcatcctacatcttttttttttttaatactttaagttttagggtacatgtgcataatgtgcaggttagttacatatgtatacatgtgccatgctggtgtgctgcacccattaactcgtcatttaacattaggtatatctcctaatgctatccctccccactccccccaccccacaacaggccccagagtgtgatgttccccttcctgtgtccatgtattctcattgttcaattcccacctatgagtgagaatgcgcagtgcttggttttttgtctttgtgatagtttactgagaatgatgatttccaatttcatccatgcccctacaaaggacatgaactcatcattttttatggctgcatagtattccatggtgtatatgtgccacattttcttaatccagtctatcattgttggacatttgggttggttccaagtctttgctattgtgaatagtgctgcaataaacgtacatgtgcatgtatgtagcagcatgatttatagtcctttgggtatatacccagtaatgggatggcagggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgtttatatcctttgcccacttgttgatggggttgtttgtttttttcttgtaaatttgtttgagttcagcaaagtctcaggatacaaaatcaatgtacaaaaatcacaagcattcttatacaccaataacagacaaacagagagccaaatcatgagtgaactcccattcacaattgcttcaaagagaataaaatacctgggaatccaacttacaagggaagtgaaggacctcttcaaggagaactacaaaccactgctcaatgaaataaaagaagatacaaacaaatggaagaacattccatgctcatgggtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtactaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtaggaagctgaaattggatcccttccttacaccttatacaaaaattaattcaagatggattaaagacttaaacgttagacctaaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatgagagtgaacaggcaacctacaaaatgggagaaaattttcacaacctactcatctgacaaagggctaatatccagaatctacaaagaactcaaacaaatttacaagaaaaaaacagtctattgcaattgttactcttattcatgatcacattgtcccatgttcagccagtgggtgtaccttccagttggtttttaaatatttatgacatgaccttcgttgtctgctgtttcttcctttgggataaaacaggttgttctcagctaatctcttgccccacatctggagcctgctacttctctgccccacccactttgcttctctgctcttcatttggaataggaagcataattcatttacctctgtggaaactctgttgttttagaaggggagatgccactctagcagtactatcagagggtaaataatggaaccaaccaatccagcaactctggcacttctgaaatttagacaagggggtcatgttgtgtacttggaatgcacctgcattatgttgtggagagcaacacaggcaaactctgaaaaccaccctcatgtgtggctcactctgaggccttcaataatgtgttctttggaattcagatctgctcactgcacataggttgcaatagacatcatattattcccataatagtcttcaataaatgcttctgaaacaaatatcaatgaataaatgacattttcagcttttagagatgaaaatgacctagcccattttgtctgatactccatttttacctcaggaaactaaggccttgatatttcaagtgatttgtccaagttcatagtgcaaagtagcagatttaatccccaaatcatctgacctcaagtgcatcgtttcctactatacctactgcctctagactgtattagatcatttagcattaattattttgatcattgtccatttcttttttttccttccttctatagggatgaaaaaactttctaccctctgaatttttgataattgagcctatgaaatcaactgacagtagacacattaacatgaaacagaaattttaattactgcaaatgcatggagtcccacaaaatatgggactggaaaatgtgttcgatgactgaagcttatataacatcctgagctacagaaaggaataggggcctgaggcttctaagggtggtggtgacacaaattatgtgaggtgaggaaaggaaatgcatgtcgagcaaaggttaccttgtcatgcagataaagtctctctggtaataaaagttgtcttcaagcagccctcagaagaataggtgcgagtctgagtcacaatctgggcatggtgtccgcccttcttgtgatataaatccatcttccctagttgatgagattcccagagagacaattcatgacaaatgtgtttctttcagaggacctgcccttcattagaaagggaaagttcagaaaaaggttctccctgcgcttttgggggagaaagaggggcaagaaacggaacagaagagcagagagaacttggttctccttcagttcaaggcactcaggatatcaaagcatcatattttggggtattgttttgtggaccccagcacctcctttatttctctttctctctgtccctcttcccttctctctctctctctttctctctctctgtgtgtgtgtgtgtttgtgtgtctcttctttctaatgtaaataacatgagcctcctgtgattgttgttcccataatagtgagtagcaagtctaacaacggttcaggtaacccccaggcaagcaaaccaaaaaaaacagcctgttcaccgttcactaagctgttcgtacagtacatccctatgcccatttccaagtcttagatgactttttctagcacaattcaaaaagtactttatttcacaataataataatagaaactcagaagctttactttctcacttacctaagtaagggtggtaatgttttaggctacagaaataatcatcacttaccataaatgaatcaccttagtgttgccagcatactgaaaaagcaaatgacaaacaagataattttgatagtcactttattgccttcctgtgaagtgctaaggaacggatttattttcttgaacgtttccccttggaggatctgctgaaatctttttaattccgaaatcagagatttgctagcttagcatttggcaaaaatgatgatttatcctatttaagcattaaactatctatgtctatttgggtttcaggtgaccagatggctgagcagggcacctttacatcttttattcttaattttatttcattaactcagcaagtatttattgaccactagagtaccaataccagataacctgtaagggaataaggattaaacagtgaaaatggcacccatagggaccttaacagagtagtggctacaacaaatatgttacagagacactgtgataaatgcaaacacagacataaacataggttgttagggaagcatacggaaatggacagctgatctgcgcttggccttgcattgcggttttgggaagtgattggtattttctgacaagtgctttgaagctgagacctaagggactaagcaaaagcagagtggcagtgtcctgcatgggggcagaatttgctggatttagaggcacttgaatattttgataagcctcacagagaattttttttttaatgagtgaaatcaccaaatgcatttgtacttttgttaaaattaaagttgagaacaccaattttagtccctttgaatatgttaactgtgctatcttcaaggttttctttctccaaaaagctatttctagctaattatcctcactaaggaaagtgatctgtcggactgtgttgctaaggctcctcacaatgggggctgctgcagtgactagagactgagtcaatgaggaaaattaaatacttccagggactgattatttgggaattttcttccaagggaagttcagagaaagcccctccctgcccttctgggagaaggggtcaagaaacgggacagaagatcagagagactttggttcacctttagttcaaggcactcagcatcccaaggcaccacactgtggggtattgttttgtgaggcccaacatttccttcctttctctttctctttctctctgtctctcttcctttctctctctctctctctctcttctttctaatgtaaataatatcttttgtctcatcaaagagtctttaattaagtctttttcctgggttggaagcaatgagaaagggtcacaaccccgtcaagggaaagtcacatataacacagcccgcagtgcccccaaggatgtaaattgcttggatgtgtttaatcttcccatgtttgaagacacagactgtgatgtgaactagggtcaacatgaaaggcagcgccatcttaggtgactttagcctgttaatagggaatcctcctgtccttttcaattgtatattttctgctgcatcaaagcttttcaggtaacggtgtcagaaagagcataatctctcaggttagcctggtacaacttaagtttaaactaactgctaactgaaaataaaattccccaacaataataaaaattttacaaagttaaacactaaagaattttttaaaatattgcataaataatttgttgtaggttataaatgtgtttattatttatatgctgcctctcattatttagatgaccctagcaggtgcctgaaaatgaacgtttacatttttaggttggaccataattacttattttgtgtatcttcttcccactagctttggtggcataaaatttgttattcatcttcacgtgcttaaggcctagaacagtgcttggaataaagcacattgttcaataaatggaagctcccatgctcacgactctgcttgccctataaggagacagtgtgtacacttaccatagaataattattatcttactgttcatctcagaaaaaaaaaaaaacacaatggttttaagaagtaccttgcaccttacacatacttttatgttgctctgtgaaaagtctttgcagtttagtatcttataaatattgtaagtaaaggtcaaattccacaggggtctataatttcaaatattacttttattgttttacctgtaaaaattttctaagtgttttttttaaacttactgttacagagctatctggtaggatctataaccccatgaactacattttattatttattttattttactttttggaaagacagagtctcaccgtgtttcccaggctggtctcaagctcctgggttcaagcaatcctcctgcctcagcctcccaaagagctgggataataggtatcagccaccacacctggccatcaactacatttcaaatggatgttttataggaatcatcattgatgataatgagagatatctgttggaaaacaaaatgaagaaagggttaaggagtattatcagcactgtcacgcgtgtctgtgtgaagagaccaccaaacaggctttgtgtgagcagcaaggctgtttatttcacccgggtgcaggcgggctgagtccgaaaagagagtcagcaaagggagataggggtggggccgttttataggatttgggtaggtagtggaaaattacagtcaaagggggttgttctctggcaggcaggggcgggggtcaaaaggtgctcagtcggggagcttctgagccaggagaaggaatttcacaaggtaatggcatcggttaaggcaggaaccggccattttcacttcttttgtgattcttcagttacttcaggccatctggatgtatacgtgcaggtcacaggtgatatgatggcttagcttgtgctcagaggcctgacaggcataatatttattgaacttctgtagactaatgggcactgttctgggtagcagagattcatcaatatataaaatctgcaaaagttaaaacaaacaaacaaacaaacttctctgacatcctggagtttattgccctttaagaaggtggtgggccgggcgcggtggctcacgcctgtaatcccagcactttgggaggccgaggtgggcggaccacgaggtcaggagattgagagcatcctggctaacatggtgaaaccccgtctccactaaaaatacaaaaaattagccaggcatggtggcgggtgcctgtagtcccagctactcaggaggctgaggcgggagaatggtgtgaacctgggaggcggaacttgcagtgagccaagatcacaccactgcactccagcctgggtgacagagcgagactctgtctcaattaattaattaattaattaattaaggttgtgggggagacagacaatacaaaataaacatcacaaaggaggaaattgttgactgtcagaaggtgatgtgtgctataggaaaaaatagaggtgatgtaggggtgggaagactttcctttatcctctgagggtttgatgagtgagtgtacgaaataatctgaagggaggcagatgaacaggagaaaagacacacaaatttgttacctacaggaggacatcactggagagaaacctgaacacccaaaaggccagtgagattttgaagcttatataccttcttcccagggaagaaggtagagtggatatagtcaaaatttaggggagagtaaataaattcggggaaagacaaatggcccagagcataggggatagtctgagtgcagggttcacctccaggctcccctcttgttttttgttgtcgtggtggtggtactggtgtgaagggtgaggacaatcagtgtgtttttcccctcagagcaaattgtaaagctaaattagtcattatttaaatttactatagttgcctttataaaaactttaaatttacattatacatgttgaaattgaagctatgcaattgtaatataaacacggatttacaactaaagcatgttataatgtaaataattgattttctgtatgaaatcctaggcaatattgtaaaattgtacagacccgtcaactttttccacttaaatattctgagtaaagtttaagggtgttgtagttttcaagtggttttttttctttgtttgtttgtttctttttgtctcttgtgatccaagttttcttctctggttggtgagattactggggcaaagatttcttgacaattgagttccttttgaaggatccttcctaaggccggtaatgggagctcagaaaaagctcctcactgcatttgctgttctccaggtgccctcagtttgaagcaaccagcatgccacagtggcacattttggggtggtattttcttagttccctcaaaggtaaaatgcagagtgggttatatgtttaaacaggacagttgggtgggcctcagtgaggacgtgccctgtgaatagaggccaaacagagatgagagagctagcccaggggagttttaggggaagcatcttctagtcagaggaaacagcccaggcaaacgtcctaaaacaggagcatctggcatgtttgtttgttggttggtttgttttgagatagagtctagctctgttgcctgggctggagtgcagtggcatgatcttggttcactgcagcctctacttcctgggctcaagcgattctcccacctcagcctcccaagtagctaggatcacaggtgcacgtcatcatgcccagctaattttttgtatttttggtggagacagagttttgccgtgttgcccaggctggtctcaaactcctgagctcaagtgatctgcccacctcagcctcccagagtgctgggattacaagcatgagccaccacgcctggcccatttagcatatttgaaccacagttaggtcagtgtggtgtagtagatattaggagtgattttttttttaatgaagagcaagcaatacgttatgaagtatccttaaataacagggagcgttctctttaaggttcctcaggaatggtcagtcatggatccaagatgacatttacttagcctccaagtttgaattcaagatcaaaatctaattactgttacaagcaacaagaatcaaagagtaacatctccttgctacacaggttagaagactccttattgccacacagatgaattcttgactagcaaatgcacataaaccacatccctacccagtgtgagtgaaaaaggaaagggaagattagcttgtctaagtatcgatgtaaatgtagtcagtaactctagctgtattttaaaaggattttaacatctctacaatggaataaaaacattaacggatatccttcttcctagaaaatggctaatgctttcctacaaaaaaagacacatatgagctccaaattgttcttcatgtgggtgagaatggtctgtcattatttatacttgttcacagtgcttcatctgtcatccatctttgggctgtaattgtgagcttaaaaataatcactattttccaccacctgcagaacataatctgcactttgagctcatttcctcagtgttccctacagagttccatctgctttacataccttatttctctacacatgattaaagctgctgatgctacctgaactgcatacatagctggcattatggaatgcctcaaactaccacagcgtgctgtggtgagatgcctttcctatcagagtctaggcttacaaaaatgcatgaagtgtttctcatatattgcatatttggggtgaaaaaagacaatgacagccaatttttaataagttatgtcagggagatcataattattgatcttctaaacaaaactatctataaatatatggtcttcaacttatccaccgggaagacagatgaaagtttcaaatggatcctcttacaaatgactaaaaaacactgcatcataatctaacattatgttgagtctttttgcctgaatgttttctaaacaattttgtagaagttagttaatactttaaataactagacattgtaactaagaaattattttgtaagttattcaggaaagtacacatagctcttataaaatgaccagtatttgttagtttcttttataaatctgaatgtttatataaagtttacctgaaataagatacatcttgctttcatatggaatatttcatgtttgtttccaatagccaaattaagaaatataatttcaaatataaaattaaagcttatgtaattttctttctttttttttttttttttctgagacggagtctttctgttgcccaggctagagtgcagtggcctgatctcggctcaccacaacctctgcctcccaggtccaagcgattctcctgcctcagcctcttaagtagctgggattacaggcatgcaccaccatgcctggctaatttttgtatttttagtagaggctgagtttcactatgttggccaggctggtctcaaattcctgagctcaggcaatctgcccgccttggcctcccaaagtgcaggaattacaggcgtgatccaccacacccagtcaagcttatgtcattttctaattctactctcctttctcaactcttagaatattttattgatatctgtgttcttaaactttacaaaagtgacatcatgcattaaatgctcctcttacttgcattttctactcaatgttctgattttgaaattcactcatgtttcataaatatacttctaattgttttattttcaaatattttataacaattgtataaccatagctcaacttattttccactcttgtcggctggccttttatgttgtttttatttactattgcaaacaatatttacaaaatatttaatgttcaagaattcctttaggatatataactagaaataattattattatgggatattctcatcttcatatttactttttattccaaattattttccaaaatagctccaagaatcagggtataggtgttcatatcctcaagaactctggatacagccacatttttaagtatttgccaacctgacaaacataaaataaaacctcattgtagttcttctttgtatttccctggttactgtgaagatgtgcatctccctgagttgattaaccatgtggtttacccatttgtaaattactggtctatgtttcttgcctatttttcttttgcgttatttccgtttctgttaactacttgtagaagttctttatgtagctggatactaatatttgttagacatatatcttacaattatctcttctactcagtggcctaaaatttcacattctttatggcatgtcgatgaagaagagagctgaattttaacaaaaccatatgtacccatttctcccattagagtgcttttcttacactttctttaagaaataatagaaaaagccggatgcagtggctcatgtctataatcccagcactttgggaggccgaggtgggcactttgggaatctgaggtcaggagttcgagaccagcctggccaacatgatgaaaccccgtctctactaaaaatacaaaaaattagccaggcatggtggtgggcacccataatcccagctacttgggaggcagagacaggagaatcgcttgaacccaggaggcagaggttgcaatgagccaaaatctcgctactacactccagcctgggcaacagagtgagactccgtttccaataaaaaaagaaataatagaaatgttattttgtgctttcctctatggattttgaaggtctgtgtttcattaggccttgaatccatctggaacaatttttatgtagggttaaagacagggatctaattttattttttcaatatgaataaacaattttaaatttctcataaatatctgacaacaggttgcatttatgtcaagtttacatatatacacagactttgctttaagtttttaaaaatttgttgcattattttaattggctgtgcctgtaccaaacctgctttaatcatgattcttgataggccaattgtctctgcattgttcttcaacaatgtcttggctattcttagaccttggctcttaaatacaaattttttccaccagttgctcaattacatttatatacacacacaaattattgggattatgattgaaaatggaattaatttatatactaagttattgattcttccagtctttgaatatggaatattcctttatgtgattcttctttaatattattcattaaagttttaaatttctcccaataagttcttgcatatattttgtgagattttgttttattacatcataaattctatttttaaaatattgtattttctcattagttattattggaaatataattgatttttgtatattgttcttatattgaataatcttttttaagctgtagacttttctaacaggtttgaaaatttatcagctccccatcttctctacaattcttaggataatgataatgattattattattatgttttactttctttttctaatgactaagaccccaacataatgttgactagaaacagtgattataagcatttctctttctgatgaaaaaaaaagattctaatattttgtgactaattctttgaaccttctattataatgaagttcttttactcttttacacatatataggggaattacaatttattcctatatagctcattttattgaaattattctttattatttctggtgccttttcttaatgtactatgttgcattaatttttaacattaaactatcttagtctaaacactccaagtataaaccaaacttgaataactcaagtttctaaaattaagaattcaagccacatgtgatggcttataactgtagtctcagtaacttgggaggccaaggtataaggattgcttgaacctaggaattcaagagcagcctaggcaacatagggagacacccatctttatcaaaaaaaaaaaaaagaaaagaaaaaagcctgatttagtagtgcacacctgcagtcttagctacttgggaggctgaagtggaaggatcacttgagcctgggaggttgatgctgcagtgagctataatcatgccactgcactccagccactccagcttgggtgacggagaggagcgagaccctgtctcaaaaaaaaaaaaaaaaaaaaaaaaaaaaaaaaagactacatctccaccaaaaaattggccaggcattgtggttcatgcctgtaatcccagcacgttgggtggctgaggcaggaggagttcaaaaccagcctaggcaacatagtgagaacctgtctcaaaaaaaactgttaaaaaaaaagaatgcaagaagatataatttgtatattacgataatcagaatatataatataactgaggcagtacaatgtaaattcaacaaaccataggcacagttctcttgtgaagccataattgacaaatattattggcaaatccatctttattggatcattcttatcagcatacaaatacattgtaatgattgcccttttaaaaatagaaaacgccatcacttttgatgaaagaaaatggcttgaaagaaaaatcgtttttttttcttcctactctcccttcgagactgatataatcagtctttctttcacatcagaccatggaaaccctcttggaaagatcatattacccatactttcgataaattcaataattaatttagtcctcattttacttaacattgaaataccacttaagtccgttgatgactctctttctgttgaaactgatcatgtggctttctctgattttcctcccgcctcctggtctacctagtcttggtctctttattggctcttctatttcccacaatttctcccacctcagtaaatggtaccatcatttgcctggataaatattcagtccaaaattctcacaataatccttgtttcatttttttttccccctgataggtctcatccaaaacatgaccagatctttctggctgtatctttacatgatagatttaaagtctattttaaaatatttaaaacaaattatattttttaatgtatttccacttctctgtcacctccactgccaccatccaaagtctaagtgaccatctcccattagctaaagtagtagtttacaagtcatctctgtgcttccactcttgccctgctactaattattgaccacacatgagccacaattacaactaaaagcataaatcattcaagtcacactactgcttaaatctctgctgtggctttccataacatgtaagataaaatctgaagactttaatatgccttacaagaaactacaatatctgttccctgcctttttgtcttatatcatttcctactcttttctctctttattgtattctggcaaaataatctgccagattattcctgcttcatggcctttccatttgccattagttcatcttagattactcttcccattgatcttcatatcattccgaaatttgctcaaatattaggatctcccttaccaatctgcctgaaatggtctctctcactcctcaatcattctccttccacttaccaagctttttttcacagaagatataagtaagtaaaataaacgtgttagatatttgtttgttttctgcttcccatgtttgaaactagactgtaagttgcctgagatgatggattttatatcgtgctcattgccgtacctctagaactcagataaatggtaagcatattatgagcaactagatatatcttttcaataaatgcatattgaagatgttcttgagtttgaagaaatgatttttaaaatatgaagtaatcttttatctccacaagttttctacacccacgcctacgatcgtgtgctagacctttcaacctatgctgcaatcttatagcccactattccagacctttccatttctgactcatccagatcctttatttccatttacagaatccctcttgtctccagggtgtgtgttctgagcaataagaaggataaaattgctcttatcaccttctccttcttcatgcgacacatccccattcatctgtcatggttcacgacaaatgctctgtcaccagcttgctccacagctttctcaagctgggttatatggaccttttatttggatacacaatatatctctgttttagcacttgtttctattttgtagtcttaagcttaatgtcctctaactgccactggaccataagctcatagaaaacaggaaagcaagtctttttcatctttgtgtccccagagcctggcactactggaccagatcaggaacttaataaatggcttgtggatgcatgaatgattaaattatattaccaacttatgacattttttatgtaataggctatacattgttgccattttaaaataatattttaaaaagtctaaaatagtatctgcatattgcccctccccacccaaaatgagtgccgtgctgtgagaaagacaataaaaattttatgcttggtttgccaccaagcataaccccactgagtcaaagagatgcagggtagtaaggtaaaaacagcacgcaacccagaattaggaaaacacatttctattattttgccactatctcttagtattgtttggtgtaacccacttttttctcctaagacttgatttcttattctctaatagaagaaagtcaagatgggtgccctccaagatcacattattttgatattatttgatagtcaaaaattttcacataagaatatagcttcctttaagtggtagggttgcttcctctggatacatgcttgtataagactgcaaagctttgagttttgaaaaaacagttcttattaatgctatagcatttaattggaaatcctagctcacatctttcttatagttagtgttcaagtgctgattgattgaatcaggataataccattaagacttctatgcccaaagaaaacagacaaaattattaagatacagttgctaagatgcagaagaaatttaaagatatagaaaatggaatttattcgttttattaagcaagccaaggcttatacgcaatataaaagatcttaagaatatgtcataggttactacctactgtgttgctatgagacctgcactagaaagatctaatgccacctgtgaaaagtaactatagtagaccataaggcagctaaggaattcagactacacattgtatgttggccacacccagtctagcaagatttatatatacattttaatttagaaagttcataatattccttttgtaaaacaaggatcatttcagagaaaatatgaaaaaaggtggaaaaaatctctctgattaacaaattgcacattaactggtacgatgacatggtttgaaaaacaaaaataatacttagctgcaaatacaggtgtataggacacatataaaaatttttcattagactcagctcatatacttttattaaaatgtgcataatgtgaacttcagactgtatatgaataacatagaaaagaatcaggaaacagctataaaatgtatatatatataataacagctattatatatataataacagctattatatatatataataacagctattatacacacacacacacacacacacacttatacgattaagaaactggttacattctggaaggaattgttttttgcttttttttcactggtcattttccagctttatcagtccctggccagagctccagccatgcaaggaattgagttcttgagaagtgaattacttgaggattacagatatgttgagaatatggggtcagtagtggaggcagcagagggatttttctaatgtgctcatgtcaacatgactacactggttaatcttgagggcccgttattgccagagacaggaacaggtctccagagtatgttccatacatgcccagtgtttcaaatataccattaaatcagcagtatttacaacaaaataaattgtgacaatttaaaaataggtgattacatgatgagacagatactaaattctcagtagttccacaagacattttcataacatagtaatccaaagacagtatttaaaaagcattagttaatccgtggcttatttgtgaaatgaaacttagaaatttaaaatttgctatatgcagtagtttctgtttgcattatatgcataaatgataacacatataaacacactaaatatgggaataagattcttaatttttctacttatgatactagcaaaggaaaatctgtagagtgtaaatacatgttttgttctagatggtggacacatgaaaaattgttcatatccatttgtcacttaagatttaatggctcttccactgccctgaagggtgagtcccggaccaggcagtattcatcacaaactgacttgagagccgtgggccttaagggaatattggagataggctagcaatattccctgtggcccgttgtggtgatgaccacagggtgacactccttttcctttggaaggagagagaagagtgggaagtgctgcatcttgtggcttgagtgacagctcagccacagtacaacagaacaggtggagttctgaggtttttgactctggtccctgattgctggaggatggcaactctggacctacctgggacctcgggtgactcgccaccctgaagggaaggacataggcctggctggctgtgctacctgatgattgtagaaccccagagccttgagcgaacataggcagcagccagggagtggttacagcaggtcttggggcaacacccagtcctgtgctggctttagatctgacccagcacaatcctagtggtggtggccaaggagtagttgtgtcactccacccctagctttcagtggctcagaacagagagagacactctatttgtgtgggaggaagaagaaagagaacaagagttttcgtccagtaatccataggattctttcagatcttgtccaaggccatcaaggtagtatgtctatgagtctgcaagaaacacagcattactgggcttggggtgccccctaaagctgttacagcttagatcacaatacccaagtccttctgaatatctggaaagctttgccaagaaggatggggacaaagaaggtgagaaggtgaagactacaataaatatctagctttttaatgcccagacatccaagaacatctactagtatcaacaccatccaggaaaacatgacttcaccaaatgagctaaataaggtaccaggaaccaatcctagtgaaacagagatatgtgacttttcagacagagaattcaaaatagctgttttaaggaaactcaaatttaagataaagcggagaaggtattcagaattctatcagataaatttaacaaagagattaaaataattatatattaattaaaaataactaatatatcatataattatatattttttaaattaattgaattaaaaagaatcaagcagaaattctggatttgaaaaaggtaattggcatactgaagaatgcatcagagtcttttaatagcataagagatcaaacagaagaattagtaagcttgaagacaggttatttgaaaatgcacagtcagtgaaaacaagaggaaataataatttttaaaaatgaagcacatctacaggatctagaaaatagcccccaaagggaaatctaagagttattggccataaagaggaggtagaaaaagagatggggtagacagttaattcaaaggtataataacaaaaccctagggaaagatatcaatatccaagtacaagaaggttataaaacactaagcagatttgacccaaagaagactagctcaaggcatttaataactccaaaaggtcaaggataaagaaaggattctaaaagcaacaagagaaaagaagcatatagcaggcaatggagcttcaatatgtctggtagcagacttttcagttgaaaccttacagaccaggagagaggggcatgacatatttacggtgctgaaagaaaaaaacttttaccctaaaatagtatatctggtgatgatatccttcaaatataaaggagaaataaagacttttctagacaaacagaagctgagggattttatcaacaccagacctgtcctatgagaaatgctaaagggagtacttcagtccacaagataaaggatgttaatgagcaataagaaatcacctgaaagtacaaactcactggtaatattaagtacacagaaaaacatggaatattataacacagtaactgaggtgtaaactacttcatcctaagtaaaaagactaaatgatgaaccaataaaaaataaaaagtacaacaatttttgaagacatagacagtacaataagatataaatagaaacaacaaaaagttaaaaagcagaaggatagaggtaaggcatagagtttttattattacttgtgcttatttgtttgtttatacaaacagtgttagttgttatcagcttaaaaaaatgtgttataagatagtatttggaagccccatggtaaccacaaaccaaaatcaaacaatggatacacacaaaataaaaagcaagaaactaaattataccaccagagaagatcaccttcactaaaggaggacaggaagaaagagaagacaaaaaaacaaccagaaaacaaataacaacatggcaagagtaacttcttacttatcaataataacattgaatgtaaatgaactaaactctgcaaacagaagacatacagtagctgaatagatgaaaaagaaaaaccatttgatctgttgcctacaaggaacacacttcacctataaagagacacatagactgaaaaataaagggatggaaaaagatatattccatgcaaatagaaaccaaaaaaagaaaaagagtagctacacttataacagacaaattagatttcatgacaaaaactataataagacacaaagaaggtcactatataatgataaaggtgtcatttcagcaagaggatataacagttttaaatacatatgcatttaacagtggagtaccgcgatatataaagcaaatattattagagctaaagagagagatgggccccaatacaataataactagagaattcaacacctcaccttcagcactggacagatcttctggacaggtaataaacaaaaaaacatcagacttaatcttctctttagactgaatgaatttaacgcatatttatagaacatttcatccaatggctacagatcacacattctttccctcagtatatggatgattctcaaggatagaccatatgttaggtcacaaaacaagacttaaaacattcaaaaaatgaaaataatattaagcatattctttgaccacaatggaataaaactagaaattgataacaagatgaatttttgaaactctacaaatactggaaaattaatatgctcctgaatgaccagtgggccaatgaataaattaagaaggaaattgaaaaatggcttgaaacaaatgatgatggaaacacaacataccaaaaaatctatgggatacgataaaagcagtactaagaggaaagtttatagctataactgtctacatcaaaaaagaagaaaaacttcaaataacctaatgatgcagcttaaagaactagaaaagcaagagcaaaccaaacttaaaattagtggaagaaagaaataataaagatcagagcataaataaataaaattgaagaaaacaatacaaaagaccaatgaaacaaaaatttggtttattgaaaagttaaacacagttgacaagcctttagccagactaggaaaaaaagatccaaataaataaaattggagatgaaaaaggagacattacaactgataccacagaaattaaaaggattattggtggctacaatgagcaactatatgccaataaattggtaaatctaggaaaaatagacaaattcttagacacatacaacctagcaagatttaaccaggaagaaatccaaaacctgaagatatgaatatccagtaacaagatcgaagctataataagaactctgtcaataagaaaagcacaggaactgaaggcggaaatctgaaagcctttcctcgaagatctggaacatgacaaggatgcctactttcaccactgttattcaacgtaatactgaaagtcctaagctagagcattcagacaaaagaacaaaataaagggcatccaaattggagtggaagaagtcatattatccttgtttgcagatgatatgatcttatatttggaaaaacctaaagactccacaaaaaaactattagaactgataaacaaattctgcaaagttgtagtatacaaaatcaacatacaaaaaccagtagcatttctatatgctaacaatgagcaatctgaaacaaaaaaatcaaaatgtaatcccatttacaatagccacagataaaattaaatacctgggaattaaccataaagtgaaagatctctataatgaaaaatataaaacactcatgaaagaaattgaggagaacaccaataagatgaaaaggtatttcatattcatgaattgaaataatcaatattgttaaaatgtccgtccttcccaaagtgatctatagattcagtgtaattcctatgaaaataccaatgacattcttcacagaaataaaaaaaaaaattttaaatttaaaattaaaatttatttggaaccacaaaagacccagaataaccagatctatcctgaacaaaaagaacaaaactggaggaatcacattacctaacttcaaattatgctacagagctagagtaaccaaaacagcatggtacagcataaaaacagacatgtagatcaatggaacagaatgtataacccagaaacaaatccacacagctacagcgaattcattttgacaaaggtgccaagaacatactcttaggaaaacagtctcttcaataaatggttctgggaaaactgaatgttcatatgcggaagaatgaaactagacttctgtctctcaacatatacaaaaagcaaatcaaaataaagacttaaagcaaagacctcaaaatatgaatctactacaagaaaacactggggaaactctccaggacattggtctgggcaaaaatttcttgagtaataccacacaagcataggcaaccaaagcaaaaatggataaatgtgatcagctcaagttaaaaaaaaaacttctgcacagcaaacaatcaacaaagtgaagagacaccccacataatgggagaaaatatttgcaaactacccatctgagatggtgttaataaccagaatattatataaggagctcaaaataactctataggaaaattttaataatatgtttcaataattggccaaagacttaaatagacatttctcaaaagaagacatacaaatggcaaacagacatgtgaaaaagtgctagacatcattgatcatcagaaaatgcaaatcaaaacaacaatgaaatatcatctcaccacagttaaaatggcttatatccaaaagacaggcagtaacaaatgctggtgaggatatggggaacaggaaatcctcatacactgttggtagaaatgtaaattagtacaaccactaagaagcattcagaacttccttgagaagctgaaaatagaactatcatatgatccagcaatcctactgatgggtatatacacaaaagaatggaaatcagtatacggaagaaatatctttactctcatgtttattgcagtactgttcacaatagccaagatttggaagcaaccaaagcatccatcaacagatgagtggataaagaaaatgtggtacatatacacaatggagtactattcagccataaaaagaatgagatacagtcatttgcaacaacatggatggaactagagatcattatgttaagtgaaataagccaggcacagaaagacaaacatcacatgttctcacttatttgggggatccaaaaatcaaaacaattgaactcatggacatagggtggaaggatggtttccagaggctgggaagggtagtgaggggttgcagggggaagtggggatggttaataagtacaaaaaatagaatagtaagacctactattaggtagcacatcagggttaccatagtcaataataacttaattgtacattttaaaataactaaaaagagtctaattggattgtttgtaacacaaagcataaatgcttgagtggatggatacctccttctctgtgatgtgatcattacacattgcatgcctgtatcaaagtatctcatgtaccccataaatatatatacctatgatgtacccacaaaaatttaaaatttaaaaatattgtatggttccaaaggagttattgcaatgtgtaatatacaagtgttacaaaataatttgtaaaatgcatcaacagtaactgttctatttcatcaaaatagagtttatatattattgtttgcatgtgctcacaattaccaaaaaattattttaaaatgtcaattaccaaagaaattgttttaaaatgtcatggcactggacttggtgggcaagatggcagataggagatagggctaatgtgcagttctcacctggatgaactgaactgtgtgtggagactcacactgtgatctgttgctccaagaaccaacaaaggaacataccaggaaaacctgaaggattcccagatcctttgaaagaagcagcacactactacaaatttcatgaaacaggtgaaaaactgagcattcccaaagtgtgagagaaggaaaacctgcctccaaacatacatttctactgggggacctgaaaatccagatcatgagattatggaagaaggatttaacctctcctggagttgaaatggatttagggagtcacatgaaatataaaagtagaagtagcagcagaaaatgccttgcaggcagtcccagtctccagctgaagcccagggaagccatctctgatgatatcttataggggcccttggggaaggcagccagaggaattgggaagtagtcacagtgcaaaggaaactctgaactgaaatttgtagttgtttcaactgggcacaaatcttctcaggtgaagtccaggagacaagcaggagtggctgcagattcgagcacaggagccgcagccaatggagtgggcagatgcaaaggagcaagggccatgcttgcttttttagtggggaagtctatgtcctcaggcaaggtcttattggggcactgtgggagtgagactggccttgccaattgcatgggggggtgggttaggcctctcactaatggctattccccacttctctggtgaactatatgacacagcagaggcagccaagatgtcttttggcctgagaaccaccctgcatccccacagtggctatagcaagccccagccaaggagaggctgagctcagacctgcataaccctgccctgacctgataggatttctttacccaccctagtagctgattacaaaagataaactcttgggagctttatggccctgcccatcacctgagaaactgaaatacttaccctggccaagttagggcaagcttagatccctccactaatactgcagctgttgctgtcttggaaacaccaccttctggttggaggccaaccaactcaggccattacagcaactcatggtagaataaccctgatcccaggaaggagaagacaacacctaattccactgcctacaagatactggctaaccagagttcctgagcgtgtccctgtgaaaacatcactgctagcataaccatcattcaagaaagccagcacactaaacatatctacaaccatggactctcacagagtctacctcacttcgctgccacctctaccagagcaggtgctggtatccatgattgagagacctgaagatggatcacatcataggactctgtagacattccccagcaccagtctagagcctggtagcccagcttggtaaccagacccaaaagagcaataacaatctctgcgttccagctctcaggaagccccatccctagggtaaggggggaagcaccacatcaagggatcaccctgtgggacaagaaaatctgaacagcagatgttgagtttcagacctctccactgaaataatctacgcaaacgagaaggaaccagaaaagtaattctggtaatgtaacaaaacaaggttctatagtatccccaaaagatcataccagctccccagcaatggatccaaaccaaaaagaaatctctgaatagccagataaaaaattcagaaggttgattattaaggtactcagataccagagaaaggtgaaaacaaacttaaagatattaaaacaaggtggggcatggtggctcacgcctgaaatcccagcactttgggaggctgaggcaggtggatcatgaggtcaggagttcaagaccagcctggccaacatagtgaaaccctgtctctactaaaaatacaaaaagtttggtgtgtggtgggcacctgtaatcccaggtacttgggaggctgaggcaggagaatggcttgaacctgggaggcggaggttgcagtgagccgagattgtgccattgcactccagcctgggggacagagcgagactctgtctcaaaaaaaaaaaaaaaaaaaaaaagatattaaaacaaaatacaggatatggatgaaaaattctccacataaatagatgtcataaagaaaaaacaatcacaacttttggaaatgaaagacacacttacggaaatacaaaaagtgtagtgtgggaagtttcaacaatagactagaacaagtaaaagaaagaattttggagctcaaagacaaggctttcaaattaagccaatcagacaaagacaagaaaaaaaaaagaataaaaaagtgaacacagcctccaagaaatttgggattatgttaaatggcaaacctaagtatagttggttttctggaggaagaagagaaatttaaaagtttggaaagcatatttgagggaatacttgaggaaaacttccctggccttgctagagatcaagatacccaaatacaagaagctcaaagaacacctgggaaattcattccaaaaagatcatcacctagcacatagtcattaggttatctaaagttaagacaaaggaaagaatcttaagagctgtgggacaaaagtatcagataacctataaaggaaaacctatcagattaatagcagaattatccatagaaaccttacaagacagaaagaattggggtgtcatctttagccttctgaaacaaaataattgtcagcccaggattttgtatccagtaaaatggagcttcataaatgaaggagagataaagtctttttcagacaaacaaatgctgagaaaatttgccacaactaagccagcgctataagaaatgctaaaaggggttctaaatcttgaaacacaccaaaatagaacctccttaaagcataaatgtcaccaggcctataaaacaataacacaattaaaacaaaacataaggtattaaggcaacaactagcatgatgaagaaaacagtacctcacatctcactgctaatgttgaacgtaaatggcctaaattctccaattaaaagatatagaatggcagaatggataaaaatccaccaacaaaatatctgctgtcttcaaaagactcacctaacacataaggactcacataaacttaaggtaaaggggtggaaaaagatattccatgcaaatggaaaccaaaagcaagcagcagtagctattcttctaccaggaaaaaacagactttaaagccaacagcagttaaaaaaaaaaaaaaaaaaagacaaagaggaacgttataaaatgataaaagaattactccaacagaaaaatatcacaattctaaatatatatgcacctaacactggagctcccaaatttataagggaattattaccagacctaagatgtgagatagatggcaacacaataatagtgggggggcttcaatactcctctgacagcactagatagttcatcaagacgagaagtcaacaaagaaataacggacataggccgaccgctgtggttcatggctgtaatcccagcactttgggaggctgaggtgggtggatcacctgaggttaggagttcaagaacagcctggccaatatggtaaaaccctgtctttactaaaaatgcaaaaaattagccaagcaacgtgatgggtgcctgtaatcccagctacctgggaggctgaggcaggagaatcacttaaaccccagaggcagaggttgcagtgagttgagattgcaccactgcactccagcctgggcaacaagagcaaaactctgtctcaaaaataataataataataataataataataataataataataatagacataaactatactctagaacaaatggatttaacagatagttacagaacgttctactcaacaactgcaggatatacattactttcttcaacacacagaacattctccaagatagaccatatgatagcttacaaaacaagtcttgataaacttaagaaaataaaaagtatatcaggtattctctcagaccacagtggaaaaaaagtggaaattaactccaaaaggaaccctcaaaactatacaaatacttggaaattaaatcacctgttccttaatgatcattgagtcaacaatgaaataaagataaaatttaaaaattgagctgattgatgatagtgacacaacttatcaaaacctctggcatacagcaaaagtggtgctgagaggaaaattcatagcattaaatgccctcatcaaaaagtctgaaagagcacaaataaaaaaatctaagattatacctcaagcaaatagaaaaacaagtacaaacaatatgcaaacccagcagaaaaaaagaaataacaaagatcagaacagaactaaatgaaatacaaacaaaaaaatacaaaagataaatgaaaaaaagtgggttctttgaaaagataaacataattgatagaccattagcaagaataaccaagaaaaaaagagagaagatccaaatgtcaattagaaacaaaacaggaaatattacaaccaataccacagaaatacaaaagatcattcaaggctactatgaacacatttacaaactagaaatctaatgtagatggataaattcctggaaatatacaaccttcctagattaaatcaggaagaaatagagattctaaactgaccaatgacaaatagcaaaattgaaacagtagtaaaaaaaaaaaaaaaaaaaaaaagccaacaaaaaagtccagaaccagacggattcgcagctgaattctaacggacattcaaagaagaatcgacaccaatcttactgaaactattccaaaagacagagaaggagggaattctccctaaatcattctgtgaagtcaatatcaccctaataccaaagccaggaaaggacataacagaaaaggaaaactacagaccaatactgctgatgaacatatatgcaaaaatcctcaacaaaatactagctaaccaaattcaacagcatatcaaaaagataatacaccattatcaagtgggtttcgtaccagggatgcagggatgatttaacatacacaaccaaataaatatgatgcatcacataaaataattaacaacagaagtcatatgagcatcccaatagatgcagaaaaagcatttgacaaagtccagcatccctttacgaataaaaccttctgcaaaattggcatagaagggatgtacctcaatgtaataaaaaccatctatgacaaacccacagccaacattatactgaatgggaaaaagttgaaagcattcatcctgagaactggaacaagagaaggatgcccacccccaccacctctatttaacatagtactggaactcctagctgtagcaatcagacaagagaaagaaataaagggcatcagaatctgtaaagaggaaattaaagttgtgctgttcacagatgatatgatcatatacctagaaaaccctaaagattcatccaaaaagctcctagatatgataaattaatttagtaaagtttcaggatataaaatcaatgtacacaattcagtagcactgctatacaccaacaacaaccaagctgagaaacaaatcaataactcaatcccttttacaacagcttcacaaagtaataataataataaaatacttaggactatacctaaccaaggaggtgaaagatctctacaaagttaactacaaaacactggtgaaagaaatcattaatgacacaaacaaatggaaacacaacccaatgctcatggatgggtagaatcaatactgtgaaaatgaccatactgccaaaatcaatctacagattgcaatttccatcaaagtaccatcaatattcttcacagaactataaaaaacaatcctaaagttcatatgaaaccaaaaacaagcctgcatagccaaagcaagacaaagctaaaagaacaaatctggaggcatcacgttaccctaattaaaactattctacaaggctatagagaccaaaacaggatggtactggtgtaaaaataggcaagtagaccaatggaacaaaatagagaatccagaaatatagccaaatatttaaagccaactgatcttcaacaaagcaaacaaaaacattaagtggggaaaggataccctattcaacaaatggtgctgggataattggcaagtcacatgtagaagtatgaagctgcatcctcatcgcttaacttatgtaaaaaatcaactcaagattgatcaaagacttaaatgtaagtcctgaaaccgtaaacattctagaaaataacatcaggaaagttcttctagacattgacataggcaaaaatttcatgacaaagcatccgaaagcaaatgcaccaaaaacaaagataaataaatgggacctaattaaactaaaagcttctgcacagcaaaagaaatagtcagcagagtaaacagacaacccacagtgggagaaaatctttgcacactatgtaggtgacaaagcactaatatccggaatccacaagaaactcaaacaaatcagcaacaaaaaaccaatcccatcaaaaagtgggaaaagagcatgagtagagaattctcaaaagaagatgtacaaatggacaacaaacatatgaaaacatgcccaatgtcactaattatcagggaaaggcaaatcaaaaccacaatgagataccacctgatatggtggttcggttgtgtccccacccaaatctcatcttgaattgtagttcccatgatccccaacccagtgttgcgggagggaccaggtagagataattggataatgggggtggtttccctaatcctgttgtgatagtaagttagttctcacgagatctgatggttttataaggggcttttctgcctttgcgttgctctcattctctcttgctgccctgtaaagaggtgccttccaccatggctgttaagtttcctgatgcctcctcagccatgtgaaactaagagtcaattaaaactctttcctttataaattacccagtctcaggtatttcttcatagcaatgtgagaacagactaatacagtaaattggtactgggtagtggggtgctgctgtaaagatatccaaaaatatggaagcaactttggaactgggtaacaggaagagactggaacagtttggagggctcagaataagacaagaaaatgtgggaaagtttggagacttgttgaatggttttgaccaaaatgctgatagtgatatggacaatgaagtctagtctgaggtggtctcatatgaagatgaggaacttattgggaactggagtaaaagtgactcttgctatgcaaagagactggtggcattttgtccctgcctcattcaagaggaagcagagcataaaagtttggaaaatttgcagcctgacaatgaggtagaaaagaaaactccgttttctggtgagaaattcaaacaggctgcagaaatttgcacaagcagcccatcccatcacaggcccagaggcctaggagggaaaaatcttttgtgtgttaggcccttgggacatggtgcccagcatcccaactgcttcagcgccagccttggctaaaaggggtcaaggaacagctcaagccattgcttcagaggatgcaagccccaatccatggtgactttcacatgatgttgggcctgtgggtacacagaagtcaaaaaccaaggttggagaacctccacctagatttcagaggatgtatggaaatgcctggatgtctaaacagaagtttgctttgctacaggggtcaagctctcatagagatcctctgctagggcagtgcagacgagatatgtggggttggagcccccacacaagactttggacttgagcctttgggttaatgctggaataagctaagactttgaagaccattggaaaggcatgattgtgttttgaattgtgaggtcatgagatttgggaggggccaggagaagaatggtatgccttggctatgtccccacccaaatctcatcctgaattataggtcccataatcctatgcgaggaccagatggagttaattgaatcatggaggcagtttccccacatcttgttgttgtgataataagttagttctcataaggtctgatggttttatagggagcttttcctcctttgctcaactctcattctctctcccgccaccctgtgaagaggtgccttctgccatgattgtaagtttcctgaggcctccccagcaatgtggaaatgtgagtcaattaaacttctttccttcataaattacccagtcttaggtatttattcatagcaacatgagcatggactaatacattaccttattcctgcaagaatggccataattaaaaaatcaaaaaataacaggtggcatggatgtggtgaaaagggaacacttctacactgctggtgggaatataagctagtacaagcactatggaaaacagtatggagattccctaaagaactaaaggtagagctaccatttgatccagcaatcccactactgggtatctacccagaggaaaagaagtcattatatgaaaaagatacttgcacacacatttttacagcaacagtatttgcaattgcaacaatatggaaccagcctaaaagtccatcaaccaatgagtggataaagagaatgtggtatatatacaccatggaatactactcgtcataaaaagaatgaaataatggcattggcagcaacctggatggagttggagactattattctaagtaaaataactcagcaatggaaaaccaaatattgtatgttctcacttgtaagtgggagctaatctatgaagacataaaagcataacaatgatataatggactttggggacttggcggggaagggatggggtgagggataaaagactacgtattgggtacagtgtacactgctcaggtgatgggtgcaccaaaatctcagaaatcaccactaaagaactttatgtaaccaaaaaccacctgtaccccccaaaatactgaaatgaaataaaaatttaaacattgtgctttctcagaaaaaaaatgacaagacgctgtaaaaatttttaattattttataaaatagatacatacgtgcatgtgtatttcttttcaaatctttccaaaatataattttattgaagaatagtatatcaataaataagttacagcatgctacttttctgctcaaaatcctccaatgccaacagttgcttgttttcctttgactacaagccagatctcttactatgacacagcagactgctggtcatgctcgtcccatgcccaaccatttctaactcccgcttcttcctattcttccttctgtcactcagtggactctttgtatacctgaatgatgccgggaaaattccagaattagaacatttgcatttgtatttcttctgtctggaatattttccccaggcattcacatggcttgctggataactaccttacacattcaaatgttattttctcagtgaagccttttgcagcttttgctgtatttgaaaaggcaatccccattcacagggtctatacttcccttccttgatgtagcttttctcccagccattatcactggcaaactatatatatatatatatgtttaattttaattattttgcttacgatctgtttttccgccactagaatggaagaatataagctccaaaactttttttttttaatcgaatttttaaaactaactttgagacagggtcttgctgtgttgcccaggctgatcttgaattcgtgggttcaagtgatcctcctatctcggcttcccaaagtgctgggattacaggcatgagccaccacaccctgcccaagctccaaaaatgtataaatgcttattgcactgtggtttccttagatacattccctagatctgtatctgtcatatcgtaagcactcaataatatttgttgaatgcatgggtgtgttacaaaacaaacatataacagataatgcataggggtttgatagagaaatgtttgtggtgagaggggcagaagtagagtttagggctgagaagtcactaggaacaaatcagtagagactcttcaatctcagcaaataggtaatatttttaaagttaatgaagttgtgtaagatagagactgtaaatgggtgaccatttggttttatttgcttaaattaatgcttgcctttatgaccattatattgaaaagacgtttatgaccctttaaagaagacatcaggtttgaaggctattccatcatgagtcaaagaaagatttggagtactactgcaggacaaggctcttgatagagatttgtgagaaaaaaaataaaaaatggaagcagtgtcagacactagaaagttttatgccagaggctgactgtaacagaaaagatcaaaaccaatctaatttaattaatgtatctttaattaggtgaaggtaaatctgcaggtctggacacaaatgacaaacagtttatcatcagaatcatgtcagaaagtgacagaattactaaaatatgatgtggcttctttgcttatcagaagaactaaaggaaggcagttacaaagaggctaaaggtaaaactggaatatatttattctacagaaaatatattaccatgggggacactgtaactgaacttttctgattgattcaagaagagcaaactggaaagtgctctagcagagagggatgttgttatagatgaaaggggtttagagcctagaagatgaagtcacttgtctagagtctcacaggatagtcctgaccaagccagaactgggaccaaaatgactttaaactgttcctagattgagtagcttggatctatttaacttttacttttttatttttttattttcctttaagttcttggatacatgtgcagaacgtgcaggtttgttacatagatatacatgtgccatggtggtttgccgcacctatcaacctgtcatctaggttctaagccctgcatgcatcaggtatttgtcctaatgctctccctcccatttaccctgcaccccccaacaagccctggtgtgtgatattctcctttctgtgtccatgtgttctcatttttcaactcccactcatgagtgagaacattaactttcgttaattcctctttctactcaactaatatttctgaagccctactatgtgccaattattgtgcaatctctgctttcttaacttttaatgtggggggacagactttaaaaaaataaaatgtgtgcaagtaaaggggagatgaatgctagggagaaaattaaagcaggaagaggaggcagagagcagctgtagaataggaaaggaaaggctggcactggaagagaagaaggagtgggtcctgagggtgccgaggaaagacaaaggaagcagcaggtgcagaggcactaaggagggaccctgctgatgtgtttgaggaatgaaaggtccatatggctggtgccaaaggagcaaggagggaggattgacatgtgagggcatagaggcggggaggagccaggtcacggagggacttcagctgttttaaggacttgacttctactggaacaagacccgctgccattgaaggctttgagcagagtatcagaatctcacttatatttgaaaaacctcaccctgactcccgtgttgagtgtagatgtgaggaggcaagggtggaaagcagcagactggttaggaatcaggatggctttaaccctagtagtggtggtgggttggcaggaggcgtgttcaaattttggaaatacactgaaggtagagcagagaggattcatgggcaggcttgatgatgaatgcagaagaaagagaggcattaatggtgactcctgggttttgtcttgagcacctgaaagaatggagttgccatgtaccaaaataagaccaaatgaggaggaagttcaataagtctcttttaatctacagcacgctctctcttgcgctctgtctctctctcaccacttctttcctctctacccacttcctttgcaatttatcagttgataaaactatattggtctatagagtttcccacgggcagggatttcatggagtatttccctgtgtgctatttaatatgttcctctctcccttataaattctggaaatccagaatttaggtctatagacttggtcaaattcatgcttgatttttatcaatagtacattacgtgtaacattgattgtgtattttcatccaaaggtgcatcatgtgtggtttcacttgtggttatattagcagccattgataatcattgcttagatcctactaaatttgtcagaagttaggaaatcatgatactctaatcccaccatttagtcttcttttatgagctgaaatatctccataaagacaatatttggtttcattaaggttcctataacaaagaaaggccaaaggcttgattcttctctttattcgccaatattcaaaataatgagttggttacctagcatcttccaaaattaaacatttttaacaattttaataaaattaaggatttaaatatatttgatatgcctcaatccattgcagaatattcttgttgatgttcagattggcccatctttggccctgggtgtttttgaactgccctcagtctctaattgcttctttttttctactgggatatgttcctggctcatctttcatcttgcacatttccagccgtagaagccatcatttctccagggatcctagttttatcttagaggaaatggtatttagtgatcacagtctggtgcacgaggtcagtccttgtgtaggagctttttcagtgcacagaggcaagacatatgccacatttaaaattagataacattatcttaggttcttagagatgcttctaactaaaatttaaaagtatatggagcttttatttaaccttatctattttatatctgcttcttttctcgcagtgaaattttcagggtcaaaatcaccaagataattagtcacttgctttattccacatgtacagaacatttcaatagcagagaatgcaatgtctaattttgcctaaaaggtcagtgtgaagagaacatttgttgacaagatgaggatacatattctgatgagagcaaacaccatgtaggaagactcagaggcttgaaagagagcatagttcatttaggaaagagaaaatcctgttccaccagaggaatgatggatgacaaagtcagcaagaagttgggacataatgagcctgatattcaatgctgcagatgttagagcaccaacaagatacaaaagctttttttttttttctttttttgccttgctttcaggaggtatcttgcatttgttttcaataaaaatattactttcctactttgtcctcataagcagaacttagggatgagcaaagagcagggggttttaaggattgctctccttaacactgttctacaccagctcagtaaaaagaccatttaagtgtggctcaattattttctgacatttggagaagcatttgcatactaatgatccagggtcctggttgtttttctccccacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccaggtaggctgagaatggaatgttacttttaatcactatctcagctggtgcttagaattgcctaaagaatccaacaggtgtggttcattatcttatagtctagtcttcagtaggaaggaagctgtaaataagtaaaataaaatcattgggcttgttttctggggaatgaagctaagaaagaatgattttgaggaaaaaatagtccattgttttaaacttacggatttttaaattgtatgtgcatatatgtttctagtgcttaactgtcagtagtggctgtgggacaaagtttatcagagctccttgtgaacattcaagcaattccctttgagagcttcaggtgtctttattgtaaagatgaaagcattctaaaaattgtctacagccaaataggatatagaatagcgatagaatttagagctctttcttcccagtagttgcttcacagtacctgtttgtctcaagaagtctagcctgattttttgttttcatgatggccaacttttagcatgtgctagtgtgtgtgtgagtgtgcacatgcaaacacacatacatgtgtgcaagactgtgtccgggtgtagagaacagagagattccaaaagatatactggaaataactttactgcaacaagttccatatgctctgggagtcttggcagtaaattcgagatgttgtcagaaaactgcatctctgtgtctgtagtaaaacacagtggaaataagtcaaagaaacatgagctcataatttccaaccttaccacttcccaagtatgtgactttggtggagtgagttgacctctttttaaaattttaccttaattgacaaaattgtatatgtctttcgtgtacaatatgatatgatatatatatatatatagtgcaatggctaaatcaaactaacatatgccttgcctcatacatttattattttttgtgaagcaaatacttaaaatccatgcttagcagttttcgagatataataaatacattgctattaaccgtagtcaccatgttatacaatagaccttttgatattaagcctcagtttccagcgactttttctgtcaaggagaaattataatgcctacttcagggtgattgggagaatttcataaggtaatatactaggtacttataagacttgatacacttaaggacatgataagtagcaagtagtatattgattttttaaaatcatgttaagcaactttgtgctatgtcagagaccaatgggctgttggatgccccaaaacagcaatgaattgaaagcaatgttgtagggagcagtttacagagaagagttataagcaaacagtgataaggctccgatgactgaaggaacaccaaggttcttaatctcacgcagaactggataaaacgacatggacatacgtggagtggttttaaggagaggagagtttaacaggcaagaaagaaggaaggaggaaaaaaacagctccctcatacagagacagagagaggaagggattccaatgagagaaaaccctgtgtgtggtggtaaagtggctgcttatatgaggaggctggaggaggtggtacctgacttgcatagggctcagggaattggtttgaccgggcacgttattcacgtagcccagggggaaaactggccctcccaccctagccttttaatatgcaaaggcagggcgccatgatgctctacccacatggagatatgtgggggcggccatgttgccaggcacatgtgagggcaaggaagaacagggcaggaatcgccatgtttgggtggacccagtttctaatggccggtatttgcacatcaaagcttgccggcctggctctaagagcgggggctttcctgctagacaagaaacattttggagctgctttaaaagaccccttttcccctctatgtgtctaaaataatttcttaataatttcttaataacttctataacgatagtacacaatattgtgaaaatgtgagtgctttctatgtgcaaagccttgtgctagaattatagacagagtaccctctaagaaataaggttggaaaggagggtgggagtaaactgggaaggaaagtaaatgctgtgctgtggagttgggacttcatccagagggccagtacttctcagactttagtgggcattacaatacctggtgagataataaaacctgctttgctgggctccatttcctgagtttctgattcagtaggtctcaggtggtgcttgagaatttgcatttataatgagtgctatggactgaattatgttcccccaaattcctgtgttaaacccctaacacccaatgtgactatatttggagatttggctttcagtaagtaattaagattaaatgaggtagatcataatggtggggtcctagtccaataggattggtggcctcaggagaagaaacagagctctgtcatgtgagggcatagcaaaaaggcagccacctgtaagccaggaagagagccctcaccagaaacagaatcagccaaaaccttgatctttcacttcccagcctccagaactgtgagaaaataaatttctgtcattgaagccactcaatctatggtattttgttatggaagcctgagcagatgaatacaatggggttccaagtgatgctgatattcctgctctagagaccatgctgagaaccagcacaactcttttttctgttcactttcacttatcataggtgtgtgtgtgtgcgtgtgtgtgtgtgtgtgtgttttaactggattctgtttccagtgccaggaaaagtcaaagactgtatgtagaagaccaagggcaataagagccactaatgaacctcatcagcttgtcttcactgtttcatgagcggctgctccttattgaagcccttttcacagattccagttaattagtcttcagtcctggggtaggggtggaggtggggacaaattcctgaccagcaaaagaaccttggtactctcagctttatgttctttattttctttctttcttgtattaaactccaaagtcagctttcagtttttgaattttgctctggtaattaaaaaacacagtatggcttccaaatatgttcaacttacggttgaggtaccaggagaattagactagaggtgggaaaatagttcacctttagtgctcctggtcttgcagttcagcatctttctttccccctcattgacattccttgtctcttcccctcggccaccgtgaagcctcacacacataaccactctcctttacaaaacataaaatgtacaaaacatcaggaaaaatgggataaacttgttattaagcactctgttagttgcatttcctaataatgagatgaagacatttttctttaacctctagatacccctttcacgagaaaaactgctaaattgaaatcaagagtaaacttttaatctgaacagtaaatatatcactttctttgtatttctagacatctagacactgggtttcccatcatttgtagattattattgtacataataaataatacttcaaaaatcagtttctcataagcttcttgcctgtttggacattctatatatatatcaaatctttggttcacataggatttgtacttaacaaatgtttgctgattcaaatgaaatgaataatatatagctttaagtgttacctcacccaaccttggggcagtggtttaagcaggagtgtgcatcaaaatttttaggttgcttgtcaaaatgtggattgaatggccttactcccaggctttgatagagcttggttggggcctcagaatatttgcttttaacaaacacccatgggtaattctgtgaatcacacattgagaaacactgtctttaatttatggcatgaaggtttctcatgttggaatttaaggtgttagtccttcatgtgggagaagattaaagggaatattagggcttgtctgacccattgaaataaaatggcatacatagttacctccttcagctaaaataaattggcataataaaaattttaaatccttctgatataccagtctctaaatatcgtaaagtgaatttcagcttacccttctgagtcattttttacactcccaattttcattttccaggcctactaatctgcagaatagctgacgcaaggaaaaggagtggttgagacagcaagttccttgtattgttatattttgcatatgtcaaaacaagaaagaacacaatttaataaaaatctttaatttgtgttttaaagaagctaatgtttactgtaattgatttttttttcctccttcatggtaacattcaattttaaatatccatttacttattcttaactaagactgaaattatattagaacttctgtagtagtacttgtgacatctgttcaaatacaaagtatattcattatagtgattgcaattaaaatgaatatcaaatgagtttgtaatagctttgcgcttaaaatgttattttttattttaagagctttacgctcaagagttcatttggggctctatagtttctaatgatacttatgataaagagttgatattcatatggacctcatttttattttgataaatattcttttataccataccattagctagtaaatgtaaaattacccattattagtatcttccaatttttacaaggatagtaatacatgccttgtaatgtgctctcttttattactacaaaacttaaaaatggaaacaaattaaaaataatgattttgccagtatttatggtcatgtccattctcgcaatgtaactgttacttcagttgtcctcagctttacaaaatacacagaaatggaaaaataaaaagttattttattttacgtagaaaagcctgcttagaatgaggcataccaatttgggaatcaccaaattagttctacccaaacagagaaaaatcattaatggtcatccaaatggatgtctacatgatttatatttatatccccggatttgtaaatgtaatattaccttaacttatgaagggctaaattagtgaacagtgaaatctacttctcaaataagtaccataagaacttgaatttggccgggtggggtggttcaggcctgtaatcccagcactttgggaggccaaggcaggtggatcacttgaagtcaggagttcaagaccagcctggccaacatggtgaaaacccgtctctactaaaaatacagaaaattagctgggtgtggtggcatgcacctgtaatcccagctacttgagaggctgacacaggaaaatcacttgaactcgggaggcagaggttgcagtgagctggtatcatgccactgcactccaacctgggcgatagagcgagactctgtcgcaaaacaaacaaacaaaacaaaacaaatcttgaattagataaatcaagcactgagggagttcccttagagcctacttgagtagtcttagtcaacaatactaatacttttagataaccaaaatgtttctctgtatttggacaagaactattatgctgccattaaaatgtttatttgtgtatcttacatacattgtagtcatatatttattttacaaatcatattacactttctagttaagaatttttttgctgaagtattgattccttacatatatatttatttaattgtagagataaaaagttatcttccctatttttctggctatatttagccctgttttgttggtttccagtgtttttcctcttttaatttttcagtgttggctagttttcatgaatgatactttttactgcttcttttgttgaaagaagcaatataaattatatatatttttggatagtttactattagattttgtatctattgaaattgaattatgcttacaatttttgcctataaagtaagctgtgtaaaattcagcatactttatgatactaaactgtgatttagtggctttgaaaagacaagaaaacatgactctggcattgtaacatataatctatttttagcaagaaattctaaactttggtgcggctatcaagcaaatgaatttcaagttatgctgtgcattataagaagctgcagcatttaactcttaagacgacatggataaatcaattccaataaaagatttttcagtaaataaaatttattgtgactaatcagtgtattaatcagaagattatttacttaattattatacccactcattgtattaaaattgggtgatataattaaatgagacaagcaacgaggatagtaataactaaagggtaaaattagaaaattgtatcgagtaatgtttcatactcagacaactagcatctgcatgatgggcactgtaattgaaggggacagagggattgcagggagaagagtaagcaactatttcaacaatatggataggagttgatgagaacctcaactggaataatgagtaggagaataagtcaacaaatattttttagttttgcctgtgtatcaggaagtgtgacatataagctgatatgggaaagattcatatgagttaactaagaaaaaaatgagagaaggattctgggttagcgatgtcagcatattcaatgattcagagatggagatcaagagacactaatttgaaggaagtgagaggcgtcagaatggctggagtagtgaacttgaaggtgggagaggcagaaaaatggaaaccggaaattaattcagagtctctacctaatgttgaggattttatttgaatggcaaacagaatgatttcaagtagggaagttctggctgttccatggatactggagtggaggaagcagaggtggtgggaagagtctgtccgcaccagagtgcacatggactgcatgtctgggaggccagctgggacttgagagaaagtttgttgttgttgttgttgctgttattgtttttaagtttagatgctggaatcaacaggagttgtgattacttatatatacaggaggaagaaaattcaagggtgactcaagtttctgacttgaaaaactggccaacagttctaaggcttaccttgtttattaagaaaaaactggagaattggtggtcacttagctttaacatgcaaagtgatggcactaggaatacaggtttttatgtgatctgtgatggctgatggcatagtgtaaaatccttttaactgacatcaaaagattaatgaattaaattttttcttccttgaaattttcttaaacatactctacaactaaaataaaatggaagaactaagagtatcatcagaatcctaatgttttccattcttgtatttatattgaaagatcagaaaacatatagtcaagactgacctatctcaattatgtaccaattttttttttcctcatgcaaagcctcctgtattgcttcagcttcctgggctgccttggtttcatggcacctgcatgatgtctgaagcaagggaggagcaggctgcaaacctaagcgcagacaattaaatactcctgcaaggaagtaacacgttgtgtgtgtgtacattttatggaccaaagcaagtcacatgttttgctgggcctaactttagaagaggacaaagtacaatcttcccatgtactcaggagcaaagatcacgtggacttattgaatagttgtaatgccttcttaagatgactcagagaggtaatgggaggagaaagaaaagaacgcagaagaaaagaaaaatactaattttgtttatttgtttgtggatggaatgttattatgttcactttttttttttttttgagacggaatctcactctgtcaccaggctggagtgcagtggcatgatctaggctcactgcaacctcagcctcctgggttcaagtgattcgtgattctcctgcctcagcctcctgagtagctgggactacaggcgcatgctgccacgcccagctaattttttttcttttttttttgtattttagtagagacagggtttcaccatgttgcccagactggtctagaactcctgagctcaggcaatctgcccgccttggcctcccaaagtgttaggattacaggcgtgagccaccgcgcccggccagttcacttttttttttttaacgagggtcagagataaagagagactccactcaaaggccaatttcaatgtaagaggacacccttcttttacagattaactggtaagcaaaaaaataaaataaaaaataaaaatactggtactacaattatttgcttccttatgaaactttctacaattcttacccacggtgatcaccattttttctgaatttctgtttcacttagggcctaacctctatcacttagcagttgattatgggctattcatggcttttcttgctcttcattgttttctggtgttttaatgggctctttcttacaataacacaaggtctttgaggacaggggccatatcttagtatcttccatcatgcccagcttctagacatctacctagatagtgaataaattagaaaaacactaattttaaaaggggactaaagaagaggatgcagctagctaaaggaactgaaaagttattaaacagtaggaagaaagaatcagattaggaaagtcctataattgggaagctaagggagatgggtatttaacaataaacaggcaagcaagtaaaaaaataagcaaaagcaagaaaattgaggtatggtgaatggtgagacatcctagagaggaagccatcccctgtcattatctgttgggaggctgctggagtttcatgtcagtggagtttggtggattgagccactgaagactgcatggggaaaggaaagagcaggggtaagttttcaaaaggttgatggtacgaggatggctacatgtagaaaagctgcttaatcagatgacaaagcaagagtaggggtttaaaaatgtttgatatttttagggatgaggagttgtaagtaaatttataaactgagaaggagacattggagaggttcagattaaagatgtaagacagaaaaggaataataggtcccaggagagaaagaagagtgtagaatttgctttggtaaagaacaaggacacctgtttcaagaagggagctaaagacaagggcagaagttctcattaaatgtcttgaacaataccattctagacatttatctcatttaactctcaaagttacgcaaagtagattttattatctctgttttgcaaaataggactcagaggaataaacttactgaaggctaccatattagttcattttcacgctgctgataaagacatacctgagactgggcaatttacaaaagaaagagttttaatggactcacagttccacatggctgaggaggcctcacaatcatgatggaaagtgaaagacatgtctcacatggcggcagacaagagagcttgctcagagaaactcgcctttataaaaccatcagatcttgtgagacttattcactatcatgagagtagcacaggaaagacctgcccccgtgattcaattacctcccaccaggtccctcccacaacacgtgggaattgtgggagctacagttcaagatgagatttgggtgtggacacagccaaaccatatcagccatcattgctggaagtggaaaaactgagtttcaaatgtatatctatcctattaaaaacctttctgacacactgaagaaactgtgaacatggagaagtcaatgcttggccaccaaagtgagtatagaactaatcccggcaggaattgtacccaccctcatctcttcaaccactatgaaagaacgttttccctcttgtcattttcttttttgtgtgcatgattagaaatgctatttaccaagtgacctttggtcagttccagtatttctgattaataaattaatcttaaggtaaattttattaagggtagctcgagttgtactaaaagggtactgctagtgcctttcaagtggcagacttgagctttgaggtgagactttgattttgtatgtagcttagtctttaaaataacaaatataaggatgaaatggaaactctgtgaggttatccagtcactctgtagagcttgaaaatctgccttctcatgtctttctgtttaaggtagactctaaccttttgattctgaaaagccatgttcaaataaatacttattctagtatagaataatcataaagcaaagtgaaaatgcaaagactgcatgagaattatgggtttcatgtttatttctccttgtagttatctggctatatgttttcttaagttttcagacgggataccacactgctgttaatcttttttaaacaaagattatatattaaaatgagagcaacttagaaattacaccaaagctgaattttctttgaagatgatcacatcttaatgaacggatttgtcctaatttatgagaagtatgagtttatagagttgcatttaaactaaacttcaatatattaaaagaccataaagccaagtttttaaaatttgcattttagtttattatattataaaagattgtaaaaatgaagaaacggctattatccaattcaaaaaattaaaaaactacttttggactatttttcaaaattccatactacttactctgccattctgaataaaaaaagggataatcataaaaagtcttctaaaaagattggatagataaaaaaaaatgtactttaaactttgtgaaggataaaataatgtaacaaaatttaaggagaaaatttttaaaaagtactgacaattttattatttatctttatgaatattactctctagtttttgcttccatctgtacatactttcacagaaacaaaactggaatgaagttaatctgatagtcttttctactgacattaaatcgtaattttttccagttcatatattttccttaaaattatccactttaattacatcgtaaaatgaagataaacttaattcatcacctgataaacctaatcgtaaattatttttgaaaatacctcccctaaacaagatactgaaaaaaagcatcagagttttacaataaacttctcttggaaatacctaaagtattactaagatattgctcagttattcattctgcaaacatttattgagtataaaatatttagctgggtgctatgagaatacaatgagggtaaaaataatacagttgacccttcaacaacatgagtttaaactgtgagggtctgcttacatgtggatttcttctgtctctaccacctctgagacagcaagaccaacccctcctcttcctcctcctcctcagcctactcaacatgaagatatgaggatgaagacttttataatgacccacttatgcttcatgattagtaaacgtatgttctcttccttttaattttcttaataacattttcttttctctagcttactttattgtaaggatacagaatataatatatataacatataaaatgtgtgttaattggctgtttatgttatctgtaaggtttctagtcaacagtaggctattggtagttaagtttgtggggagtcaaagatgtaggtcaatttttactgcacagggggttggtgccccaacccctgagttgtttactggacttttaaatagcatttgccttaaaatatagagtgaaattttttttatgatgacaataaaatcattttgtataagacttataaatactgaaaaaatcttaactagtatgtccatcatggataaaagactgaataaatttagaattcataatgacttccaaacattttgatatgtgtattttgcattaggtaattctgcctcccctgtttgaagaggttatatttggaggaaagatgaggaaggcttaggaatgggagaaaatagggtctcagagtactattagctgggatatcagttcaggttcaaccggagaaacagaacaagtagaagatatatttagagatttattgcaaggaattggcttatgcaacagcggggcctggcaaggcaagtcggaagctggggcacactatcaggaaggaaaggctggaactgccagacacaaactgaagctgatgtccacaggaggtagttcttcttcaaggaagtctcagctctattcttaaggcctttcaactgattgaatcaggcccatccagattatctagaatatgctcttttacttaaactgtaattacatttacaaaatgcctatgcagcaacacctggaagagtgtttttttgaataactggaccccgtagctaagttgacagataaaaccgaccatcacagtcaacaaagatgacttttaatatgaactactgataaatctatttctagaatagcaatgatttattccctcatttgtatcacatatgcctctctaggtcagcatagtcaggtgagatccacctattacaggtatggagggatcttccattgtcctatcttttcatttctaatgaagatacagtttggttgagtgtcaaattgccaaacaaagttagaacaatggcaatttgagagaatcaagtagatcaactcagggagataagtcaaaagacaaagactccttttctctgtgttgtttcagaaaagttggctcagaaaagatggcttcattccacattttaatgaatatggcatgtgtccattaactcctcattctcttatctaaagggaagcacctccattgagccaaatacaaacatcctctttctacaaccttcggaaagctgcaatgtagccctatcttgccatcaacattcctctgcaatgttttctaacttacagttgaatcaagttccactaccatgcatcataaaggtaatgttaaagatgctcagagaaatacggttgaagaaactcatccttacagaagcacctatgaataaaataatccataaattttatttcagagactgtatctttcccgagctagtattttcccaccaatgaatgataagacttctctgaaatactagtaacactgatggaagttggattctattacctattgtttgcttacaatttaccaacaccagtggctgggtaaatagtttttataggacaatgaataatgttgcagagtgttagctgactaggaatgccacagccattatgaccttcatcccgtatcttaaaatctctataaaaacatgctcaggtattttttctctcttggtattggacctgaaattcaggcttaaaaatatattgtcatctatatatctagataactaatgcttaataattatctccaaattagatcatgatataaatgaagggagaggaaatagcagtagtatttattaaaggttcacctgggcattttatatatattggctcattccgccccaaatctctgtgagttgtatatcggaatttctattttatatctgaggaaacataactttagaagggttaattaattcacccaaggaaaaacagtaaataccgtgctgagagtccaaaccaagattaaaatctaggtttatgtacctctagactctatatattttctacctcaagaagttagaaaggaaggaaggggggaagaaaggaaagagaaagaaaggaagggagggaaaggaaggaagaaagagaatgaggcaacctaataagttaatcagttggggaatttttaatttcttatattgaaacattaatatgggcttccagcatagttaaagacccaaactttatttttttgttgttttgttaagtagtaggccaaaagagacatttataagagctgcacaaacttctttctgaaaaatcctacctttttatgttttttcaatatccactattggccctgacaagtatattaaaaaatatggtttatataacaatttgtttgaaatgatattgaaaaacatttgatgtgaaagaaacgaaaaaaacatgcctctctctacagagcatttgactttcatgtttttaatatcaaggtatttcaaatagaacatatgaattgtatattgattaaatagaaaaatgctgtaaaaggttatccccttcttttcagacataagatatggaaacgaaatgttgatgttttctttctttcttcttcttcttctttttttgatcttttcagaagaaactcttatgtctaagcctaacacaagtgacacatccagtgtttcattcttaccttataaatttgcttttgatagagttctccgagatcctgttaaaacgagaaagatcagaaatcaccagcttggcagagcccggtgggcagcacctggggggatgaacagcaggacactgatacagacatgaaattcaactatcagagatattgagacttactccattagggtagggacttgcttcctgtcaaaaacaaacaaacaaaaatatgaaatcaccctcagttcgattttgtaagtaggagggagagcagactagaggaagaggcactaggggaggaaccacgctgaggagcagaaaggagggcactgggtgtataagcagaggggagggaggtcctgcgcaggaaggcaaggccctggtggacagcaacagcaactagaacaaacagtccactctgcaggtctgttcagccagcctgttggctatatttagtatttcataaattttataaactcatgttactttagttggctcaaatgttaaaatcaattaatctttctctttagaaggcagatatttaagcctacctagaaaccaaacatattttattttgtttttatttcaaaatctcaaaatggtgaggtaatcaaggcagcaaaattaagaggatcaacattatgagacgttgaagtataccaaaagaagcttaatatgtaaacgaggacaaacaggtttctgctccattaatcacagttataaatttgcataaagagaactgggagaacaatttataaggttctaatgtaaatataagaaatcttaatgaaatggtatcaaccaaagccgagaaaaagtgtgtacctcctaaatgctggttatgctacataggtctcttagattttcacaaatgacttgaattttggaataactagacaaatgttctccaaactaataaaagatggccaaaaggtagattaatatagtaaaaaattataatatacttttttggcatcggaatgttctaaaataattgtttaaatataggtgttagcaatatccaaaaatatattctaaacctgatgacgaaggtataagataatcaatggcaatgatttgtctcctccttctatccctgagcaatttcttattctttttccttccagtctgggaataaaccactttctttgtttagccataagaaacaactcatccattaaagttttatcatgagattgcagcaattcagttacatcttcagactccatttctaatgctaattcttttgttatttctattacattcgcagtgacttgctccactgaagttttgaacctctcaaactcactcatgatgtttggaatcaacttctttcaaactccttttattgctaatatgttgatttcctcccatgaatgtttttaatggcttctaggatggcaaatccttaccaggaggttttcaatgtagtttactcagatccatcaaagaaatcactatccatggcagctatagcctagcaaaatatatttctttttttttttttttttttttttgagactgagtctcactctgtcgcccaggctggagtgcagtggtgtgatcttggctcactgctgcaacctccacctcccaggatcaagcaattctcctgcctcagcctcccaaatagctgggattacaggtgcccgtcaccatgcccggctaatttttgtatttttagtagagacagggtttcaccatgttggccaggctgatctcttctgacctcaggtgatccacccgcctgggcctcccaaagtgctgggattacagacgtgagctaccatgcctggcccatatttctttttcttttttcttttttcaaggcagagtctcactctgtcacccaggctggagtgcagtggcacaatcttggctcactgcatcctccgcctcctggattcaagcaattctcctgcctcagcctcctgagtagctgggattacagacacatgccaccacgcttagctaatgtttgtatttttattagagatggggttttatcgtgtttgccatgctggtctcgaactcctgacctcaggtgatccgcccatcttggcctcccaaagtgctgggattacaggcgtgagccaccgcgcccagcctattttttaaataatataacttgaaagtcaaaattactcctttgtccatgggcaatagaattcatgttgtattagcaggcatgaaaaaacattaatcttgttcatctccatgagggctcttgcctaaccaggtgcattgtcaatgagcagtaatattttgaaaggaatatttattattttttctgggcagtaactctcaatgggcttaaagtattcagtaaacctgttaaagttgtaaacagatgtgctgtcctccaagctttgttgttccatttctagagcacaggcagtgtagagttaacagaactcttaaggatcctaggatttttgcaaaagtaaatgagcactggcttcatcttcaagtaacctgctgcattagcccctaataaggggctgtcctttgaaggtttgaagccaagcgttcacttttcctctttagctgtgagtgtcctagatggcatcctcttccaatagaaagatgtttcatctagattgaaaatctgttgtttagtgtagccaccttcatcaattaccttagctggaacttctaggtaacttgctgtagcttctatatcagcatttgctgtttcactttgcactctcacattacgaagaaggcttctttcctaaatctcatgaaccaacctctggtagcttcaaatttttcttctgcagacttctcacctttctgagccttcatataactgaagagagttagggccttgctctggattaggctatggcttaagggaatgttgtggttggttctatgcagaccactaaaactttctccatatcagcaataaagctgtttcacttttctatctttcatctgttcactggagtagcactttcaattgcctttgagaatcttttctttgcattcacaactttgctagctgtttggcgcaagagggttagcttccagcctatcttggctttcgacatgtcttcctcactaagcttaatgatgtctagcttttgatttaaattgagcgatgtgtgactttctttcactcgaatacttagaggccatcttatggttatgaacagggctaatttcaatattattttgtctcaaggaataagaaggcctgaggagaaggcaaaagatgagggatcagctggtcagtagagcagtcagaactcacataattatcaattaagtttgtcatcttctatgggcacagttaatggcactccaaaacaatgacaatagtaacgtcaaagatcactgatcacagatcaccataacagatgtaataataatgaaaaattttaaattttgaaagaattaccagagtgtgacagagagacacaaagtgagagcatgccattgaaaaaacaaacaacaacaaaaaaacccgatgccaatagatttactcgaagcagggttgccacaagccttcaatttataataaagcatatgatctgtgaagcacaatgaaatgagaatgcctgtgtatatctgaagtcacccaatggaggatgtatcagtgcctatgtctctgtgtgggaacataacatgatgtgtctgtgtgtgtggtttaaatatataaataacacacacacactcacaaacacacactcgtggtttcaaaaagaaactactcaagcacaattcttctactcaaaatgtccctgaagtgagacatttagctctgatgaacttctatactatgtggggcagacttcttgaaaataacaatacacagagcttatttgaaaagcaaacaaatcagattacttatatgctataggtgtttgctattaaatttgaaaataacatatgtggggagaataatcaggctgtaggtaactaaaagttgactgtcatcactaaattaactacaagtgaatccaagattaaaagtgacagaggcagaaaaaaataaaaatgaagtgtaatgtcatacagctgaaaccagagtaatttaccaagagcagatacaaattcaatgggaggggttggcttcggtgaaatatgggagataaagatctaaggtaacatagactaaatgtaaattttaaaaaatgatctgaggtgagaatgttgtggaaatatgtaaccaatatttttaagaactgtttttttccatcaattcaacattgctgttatcctgtttctagtttcaccttaatatagaaacaaagcaattccagtaagatatataaaatatgtgcaggcatgattcagaggaatagaaaaaagaatgaataatttgaggaggaaaaatataattggggttatatatgtaggataaaggtatataaaacaagcccttaaaaataatgttaactgccttgaaaatgttatttttaatgagaaagtagattaatgaagacattggccttcacttgtattagaaaggatttagcagagattttatctgaagcaacttcttagcatagtgtaaatgaaatatttgcctgagtatcgggtttagaagtttcactgaaaggaaaagaaacttgacttgctgcctcaaattctagtagctgaaattatatgaggtgaagtttccaacgctgtctcttaagatagccgacctggccgggcgcggtggctcacgcctgtaatcccagcactttgggaggccgaggcgggcggatcacgaggtcaggagatcgagaccatcccggcaaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagtgagccgagatcccgccactgcactccagcctgggagacagagcgagactccgtcccaaaaaaaaaaaaaaaaaaagatagccgaccttaccttaatgaattttccacaaacctaagtcagattctttgggcaaaacttgacttatccacagactctagttcaatcacaagcataatcacagtctgtgagactgaaatccataatcaaaatgccattaaattaacttaaaacaagaagactaactgctaaagggagaggagggtctggccaccacactgtgtgggtaaggtatatggagagccaaattgtaaactaggatgccagtgtattaatttgtaatgaaaaagtgtattgctgaaaggactggacacttctgttctctaccccgccaaatctccccctgcagggctaccagatgggaagccaaattaaaatcagatgcttgcttcttgggcttggaattggaacaagaggagtaaatgataggattgcaagttcagggtaacaggtcatctttggactgtggagccctttctcctaggctgccgatggctatgcacaaacttgatcttgtttactgtgctttcccctccagcttcccactgaccctttgttttttctatagttctgttaatgtactcaatcaggctacagtggggtcttgctggcctgggagctatttagttctctttgtggtaattttgttcccatctttccactgagtgttgatattttagtttaactcacaaggcacaatcttatttttggaactcttcagggaggcccccctcaacccagcactgacgatgtaagacaacagagatgattgcttaaatgttttccaatcctacatctctgtggcaaaaagttttttaacactatattatggcacacagataactgaatttcctttccaaagagtagaaaagacaaaggaaaggaaaatctgggtggactcagaagatgtggcctctataaaactaaatcctcaatcttttctcatttctaagaaggggaaaaatgatgatgattgagatgttggaattcattgtcaggaaacttgaatttttgctccccatggagatcaaatggaatatgcagatggagtactttatttcttggtagcttttatagatattttgatcattttcttcatattagagatttcaatttgaaattgactgtgaagatatagaaacacatgctcagcagaaacgtcttacgacatattaaaccattttctccctggaaactgttgtgataataaatactaccaacatagaggaaaccactggggtggataaaccttattatctatctgtgcattattgttaaaaatactaaaatcaagccatgtgtgttgcatggagttctactggaaagctatcatgtaataatacaaaggaagataagagagaagaaatacaaatgggagtgactagagagtaatacaattaatttatagccacatatattaaatttgtttaatattgacagtagatttacccctgggaaggagaagaagaaaacagaatagattttattttaaagaactcctgaaaccttaccggatgttgcctaatgaggtgatgtaacataaaacatcactcgatgctgtatttgcatactgcctttttcccctaagagattgttttgaaagaataacaaagaaacagaaatgaggtggaaaacaaaataacaaagcataaatattttctcagtgtttgcaaatattcataataatttcctatcctctgattcattagttctctcaaaagcccacctggatgtcctcagaatgcaaactgatacttaattattacattgggatctagattctttatagctatgccactcgtgtgaaaaatatgcatatctatttaagagctgtgcaaagcagtggtgatgtgagttatgccattttgctcaacacaagacaaactcctaaaaacagctttaatgtagacacaaactgttttgataaataaagctaactcttaacaagattgttcagagaagactgactttttcaatgtattcctttgtacccttttcctttcaatgtagaaccttctcttcctgctgcttcctacaaccttttcctcctacagttttctgagcaactccacttatccatagagaaaaagattttggcactctgattttcagattactcttagcccaaggtctacatatctttcccttcttcctcacccttcccaatttcacaggagacccagtgctcccttgtctcgctttaaattcttccctataataggccagaaagactctgacaccagatgcattggatttgttttctaactaaattttagtataaaaacatttaagtctagtgacatcacctcgtgcgtatggttttgcatttagtacccttcatattccattttgaaattggccattcactcattcattctctgaactggtgcatattgatcatctgctctctttaaggcactaagctaacttctatgagaggttaaaaaataagacctggtcccttaaggccagttaaagacaaggcctattaaagatttaatcttctactaaagacatttcaaacagcctttgcttaaagagaagtaagatggtaggagactggttagcctctgaaatcacattatgcctaatattggccctaaaaatatattttgttgaggtctttgttaagggagatatggggatatggggcagatgaaatcacagcatactcttcctctgtcagaattctcatgcccccctattgcacacccaccaacccaacaaacacacacattaagatataattacttatacccagacttctgtttgcaaggggctgctgtcctgcctatggctattgaaaacctatttctccatgatgtacctatctttcctgggccctttacctataatatgcacttccctcctcttccagtcatgtagtagatataatcctccagttaacccagcccctaacttcagtgttttattttgtctcaaaaatccaaatatttccatcgaatatttggtgtactttttagagaatgccgtgtcatttttttttgtaattcttcttttctaaaattcttgaattttaattttaagcggtgcatttttatttctgaaaatcaaatttggctaatgaagtgtttagcccaatccagtgaagctcagctccctctttgagccacagtctgtgctgtctaacgaaccttcactgaactcatgggtagtacaatttagtagtggtatttcagtagtacctgttgtatgcctcgacaaggctttggagaaaattcctctgttctgatttccaaattcagctcttttctctgctaattgcttcttcttcttcttttttttttttttttagacggagtcttgctctgtcacccaggctggagtgcagtggcatgacctcggctcactacgacccctgcctgctgggttcaagtgagtctcctgccacagcctcctaagtagctgggattacaggtgtgtgccactacgcctggctaatttttgtatttttagtagagacggggtttcaccatgttggtcaggctgttcttgaactcctgacctcgtgatctgcccacctcggcctcccaaagtgctgggattataggcgtgagccacggcgcctggcccattgcttcttgatataagtactagctattctacagcctgcaccatgacgtagccctacctagtagaaactttgagttagattgcagtcatcaaagccatttgcccttcctttgtctctaataaaattaccaaggacctctccttaagtagtctatcatcctaaactctcaggagatacctctgagtcttggttttctttaaggtttgcaagaaaggccaatcactcctttcttagaacatttaataccactttttaacttatttcctataataccaagatggcacacatattaatcaaaaacacaaaccctcccgatctgacataatgtagatgcaacattacacactttgcccagtaagtaccctctccacctcaaggatcctttgccctttacaaaccatgtttcaggttctccatctctatcacagcctgaagggcaatgtcccaatgtattcaggaatcatttagactatgatgggatggcacagtccctacatctgctaccaaatcaaggagctgattaacagtgcattgcagctcttggcaagagttagagtaggaaataaaattaaggtgtaggggttaggcaggaaattcagataaaactacttgggaaatgtagctaagcaagatataattatctaacttataattagactagaacatcaggcctcccatccctaaaggcttctttttgcaaagagacaagtgataccatcaggtagcagatggtattcttgtatgggtgcgagtgagtgatgaacacttcttaccttaagaatttggttgtaggaattattcctactggtgataacttgctagcttaatagttcattatttctgtgtcttccattcctttgggctagtacacttattaaattagaaaggtggggtggtctgcaaaatttcagtgacatctctacaggctagctattggcctctgccatttgatcatctcaaactatctagcaaattaatacaaccaacgaaagccgacagactacattgatttgaatataactccaatttttttattgtatttcttaaaagttctatgacatactttagtttgcagaaaacagaaagttacttagttttagagcgtgattttttttgtctcactggatgtttctggtttgtttgtttgtttgtttgtttgtttttgagaccgagtctcgctctgtcgcccaggctggagtgcagtggcgcgttctcggctcactgcaacctccacttcccgggttcaagtgattctcctgcctcagcctcctgagcagctgggattacaggtgcccacaaccacgcccggctaatttttgtaattttcgtagggacgggtttcaccattttggccaggctggtctccaacccttgacctcgtgatccacccgccttggcctcccaacgtgctgggattacaggcgtaagccaccgtgcccagctgaatgtttctgttttaaagatccttgcatgtggctctgtatgtaaccctgtccttgcaaagttgttagaaaaagataaatgaactcccattggtttaaggaattgactgtgaagagcgtgatgtaatctaaaaatcagaacaccaaaacttgtttcctctttggataagtagaattggtcaaagaacagagtttatgacttctcttcacataaaagatgacattatctatgatgaaagacctagttcttgattttcttcagattccacatggacatcttacttgctaaaagcaacgtggccaaacaatttctgcctgtagcaaattgttttcagttatgtttcctcacgaagtagtatcctgaaattaccagtttgcatactgtttgcaattattactacaaatgcagtttagcttttgtgtaaatgaatgaatttttattgtatatatttaaggtatagaacatgatgttttcatatatacatacatagtgaaataattactgtagtccagcaaattaatatatccaccacctaatatttagcttttaaagccctttaatttctaaatgtggaattggttcatttatttacttatttatccattctataactcattaattctttgtaccaacatttgctgaatatgtactttgtgtaagtcactttgttaagctctctggaaaataaaaacaaagttcaattttctgtgtagtaaaacgtgtttaaccacaagacattaacagagtactaaattaatagaaatttttcatgtcaactagtgcattattttgttatggcttccatcactaagtaccatagactagatggcttaaacagcagatactggttttctctcagttctcccagtgtgactatcaggattctaatcctgtttttgtatttgtattaaaaagtgatagaacgtatagtcaagacggatggattaaattgttcatctcgcccctaagaattaagagtttttgttggtggtggtttgtttgtttcatctctggctgacaggaagagtgaagaagagaacgctgtttcctcgtagccccaaataacatttcacctacttctaaagctgctgtgaggtatgcaaggtcttacataaagagaaaaatctgtctcaaaaatctgcctcaagattgtggagtcttgctctccttgcattcttttggtttttctgccacaattttgagacttatcctaggaattcagttcagcctttttttcgccttcaaaataagcacatttggctgcttattttgcagcagccaaaacgaagcattcggagatgttattgttgttgttcttctctatcggtccagtacagttccttttcttcttttattcctaggaaatctctttgaatctactctgtaaatagaaatggcttcccaccacacagtgaaaaccaaaatccttatcttgactttacagggtctttcatggtctggccctgcctgtatccggcctcctctctcactcttcctcttgctacgtggctagaagcaagaaaacagggaatctaatctagttttatctggctctaaacccactgctcttaatcaatacactgcaatgcccttgtaagttatttacctctctcccatacagtacgtgccaggtggcccatagttctagctcctatctccaacctgaaaccaattattttcacaaagtcacattgattaaagtataatatttacagaggtatgtgtaagagttgtagatgcaaagtttgattgcttttcacaaagtagatgccactgcataaccaaaatccagaccaaatttttacctgtgccccaatgaaccccttataaccctttctgaaacctaccccaccaagtaaccactattctgacttctgaaactataggtgtattttcctgtttatgaagtttaactcttaatttaagagtattagatatactgttttgtgtctagcctgttttgcttaatattaaatttgacagattcacctatgcagaagatagtatagttcattctcattactgtgtatgtgagtatattacaaattgtctcctattttaccgtagatggatatttgggttgcttctagtttggaagaaattcaaatactgccactagaaacattcttgaatatgtcttgtggtgaatatatattcttttccttcctcttatttttaaacttctattttaagtttagggatacaagggcagaggtttgctacataggtaacttgtgccatgggtttgttgtacagattatttcatcaccgaggtatttcatcaccttagtacccattagttatttttcctgatcctctccctcctcccatcctccaccctctgagaggccccagtgtgtgtttccctctgtctgtccatgtgttcacatcatttagctcccacttataagtgagaacatgcagtatttggttttctgttcctgtgttagtttgctaagaataatggcctccagctccattcatgttcctacagaggacatgacctcattcttttgtacggctgcatagtattccatggtgtatatgtaccacattttccttagtcagtctattattgatgggcatttaggttgattccatgtctttgtgtattctaacagtttacatcactatcagcagaggatgagaatattagagttctcattactctgtatgcttctcagcacttaatagtgtatctatatcatttgagccattctcatgagtatgtcataacactacctctttttatagaccttatttttccttaaagtaactaatttattttagctgtaggacgaaagcagaaaactcagacaaaagagaaatattacctttagcaaaacaatcagaaatgagatatcaaaaatcacccgaaatatactacctaaagaagactaataacatttccagcgttagtcggttagacctttcctttgtttgtgctttcaagtacagtcatgtgctgcataacaacatttcggtcaactacaaggcacacgtgtgacggtggtctcaggagactacaatggaactgaaaaattcttaacacctagtgatgtcccagctgtcgtagctgtagcccaccacattactcatgtgtgtgtggtgatgctggtgtaaacaaacccactgtgcttccagtcatataaaagcatatcacatacaattacaagcagtatataatgcttgataatgaaaatcaactatgttactggtttatgtatttactatgctatactttaattgttattttaaggtgtattccttgtacttctttttaggtttgctgtaaaaccgtattcagtgttatgccagcagcagcctcatacatcccatgtttactgtgtctcttgactgtatcatgttcttttgtgcttaatttaattacacattattttattcatcacggtccttaatcatcaaaattcatggctaatgtgtcagaaagaggccctgtcctgtgattgacctgaaagctaaattaaaagtgaataagaggtacaaagatggaaaatcagtaatggttattgctcaccagtcaggtctgtcccattccaccatagccatgatctcaaagaatgagaacaaaatgatggaagctgaaaagatcttcttcattgaaggcaatgagactaacaacagttcaggaagagcctatatcagatatggagaaacttctaatgacctggaatgaagaccagtcacagaagtgaattcctcccagcaccatgatgatcacagccaagcaagaagtttgttcgcaatgttgaaagaaaaggctggacccaactacaatgttgaatttactgctagctctgggtggtttaaatgattcaagaactgtttttcattacgttatgtgaaagtaagtggtgagtctgcaagtgctgatgtgaagacagctgaagaatttctgaaaactctagttttcagttgattagtgataagttgattgtgagggggaattacttgtcagagcaaatcttcagtatgaaggaaacctctgtattctggaaaccaatgccttaaagcactattatccctaagggggccaagtcaatgctggatgtcaggtttttaaggacagaataaccatctcactttggagaaatgttgcaggctacaaatagaaacttttaatgatatggcacagtgacgaccccagggtctccaagcatatcactaaacacgcactgctggtaaactagaggagccataagaagtcatggatgacccagctcctttccaagacgcccttctgaattactatgccagcaaaatgagaagtactattggagaataacatacctttcaggatttgcttattgttggtgatggtcccacacatgctccttttattggtgatctccatcccaatatcaaagtaatgtttttccctccaaacaccacctctttgattcaaccattgcatcaaggcattaaagcactttttaaggcctattacctgagaaggacttttacccaggctgctgctgcaaaaaaaaaaaataataaaaaaaataaaataaaaaaataaaagataccaatgcaattctggaaggattacgacatctctgactgcaccaagaatcttgcttgggcttggggtggtgtcactaaggagtgtataaatggcagctggaagaagatactcaagaggttcatcaatgacttcaaatgatttgctcaggatgagcaggttggaaaaatcaacaaggtggtggttgaactggcagacaacttgaacgtgggtgtggatgaggatgacatcgaggagctcctggaggttcttgagaaattgactaatgaggagttgttggaatagaacatatagctgaagaagaggcaacagaaaaggaaactgcaggagaagaaaaggaaaacccccaaggaaattcacagtgaaaggtttagaagtttttacagacctcaacaaactccttaaaaagtttaaaaacgtggaccccaaaactgaatggttcgttcatagaggaatgttcatagtgcattgtctactgataagaaaatctatgattaaagaaagaaagaaacccagcaaaacttcataaacatatttctgaaaagagtgacacatctttaaaaagagccttaagcaggtccttcaggagccattccagaagcaggcattgttatcacagtagacagcagctccatgggtgtcagtgcccctgagaacgtcccagtgggacaaggtgtagaggtggaagacagcagtagtgaccctaaccctttataggcctaggctactgtgtgtgtttgggtcttagtttttaacaaaaaagtttaaaaagtaaaaataaaaaattaaagattgaaaaaatatttaaaaatcttaaggtaaggatataaagaaagaaaatatttttgtacggctgtttgtgtttcaagctaagtgtgataaaagagtaaaaaataattaaaatttataaagtaaaaatttataataagctaaggttaattatcaaagagaaaagttttctatatatttagtgtggcctaagtgtccagtgcttctggcatctacagtagtgtgcggtgatgccctaggtgttcacatcctgtcaccactcactgactcactcagagcaacttccagtcctgcaagctccatttttgttaagtgccctatataggtgtgctttttttttatcttttatattaatttttactgtattttttctatgtttagatatacaaacacttaccattgtgttacagttgcctaaggtatccagtacagcaacacactgtacaggtttataacctaggagcaataggctataccatatagcctagctgtgtagcaggatataccatctgggtttaagtacattctatgatgtccatacaaagatgaaattacctaatgatgcatttctcagaacatacccccactgttaagggacacaaaataagattttacacaaaatcttgttacttcatataacaaaatgcaacataaaactttcaaaacaaataaatacacttatgccccataaatgttaatgtgaaaatcatatttcatcaaaaatctatattactatgttaaaatgaacagccttgtaacatatctttgcataggtccctaattaattttcttaaaataagtcccaaagtggaattcttgtgtcaaaaactatgtattttgttacagctttcgaagactactgttagacaatattgtaccctgaccaactatatgctaccaccatcctacatttttacccaagctggatgtgggaattcttatttaggtcattgtgacactagtttattggtagtcgttactggtagtgaaacaatgactccaattcacttcccagccagccatcctggaggggctctgggtgcccgggcaagccccagcctctcatctgcatgctcaattccactcttcttttgtttcccattggcaccaccattgtccgcctcctggactcatctcttggtcttctccatccttccagctattccagctatcatatcatgaccatatcaggcttggactcccccctaatatttattcgctaccataaactaaattatgttttccatcctaagcacaaacatttcactaacacccgtcatctgtttgtgaggcagcagcaggagcaggtaatccacggttctgctttctctgtactcttctagaaataggggagcttagattctccctggatcccatcttctagagatggcattactggtctcatattctattttctttcatgtattgaaacttttgttattaatagcttctgactaaagtgaaaatgtcaatgtgtaaaatatgtggggtaatgtgttccacaatatacagagaaaagctctgaaacagtctcctgtaattctggattttctgttttcttcttgttttttaaatttccgggttcttgagtccatgtggtctaagtcctgcattaatcctgaacacatggcagcagggataaagggaagacctgaggtccgtgttccaattcgccagggatgtgaatgccctggacgttctccttctgatagggacaggaggcagagaaattctaggcagaaaagggtggatccccaacaaaaccccaccctcaagcctgggaacacagtccaaagtgagaacttacatctctgtttctggctcaaatatttccttttccaaaaccatgtgtggccctgccccatcctgtgcctataaaaacctcatactcaaccagcagagagaggtgaagcagctggacatcagagactgtggctggatgttggagagaagtggcttgacttcagagggagagcttgacagcataactttggagaagaatctggccagagatggccagacgtcaggggaagattaccttcccattccatttgcttttcagctccccttccaactgaaagccacttccattggcggtaaaatccccgacagttgccatccttcaggttgttcatatgacctcatttctcctgaattccaggcaagagcctggataccactagtgtggataaaaaaggctgtcacacttgccctgtgcccctgctggagggcagccacctcatgtgagtaggcagagggacgactcagctgttaacactcaagccgtccacggatggcagagctaaaagagcactgtaacactccctctggagcttcaggggtcatgggcatcacgccagactctgccacggggcctgcatgaagtttgctcctgctggtgcccaaaagcactggctctcggctcctgcctccacttacccgtgtgctccttcccatgagtggtggagcacagcggatccgagtgagtggagctggctcctgcctgcgctgaagcagccagttggttccagtgtttgcgcactccagttctcacctcgttcatttcatgctctttcctgcaaggagttgacggctgtgagctgggcaaatgaggcacccggttgcaagttccatgaaaggctcggggaaatatcctgcttcacttccatatggagctagtgctttgtaaagtgcactgacaataacaaagtgtagaggaggaccggacacaggctgaactgagcttcttgaaaaggctgcagctctcagaacaacgctgagaaaactggtccttcagctatagacacagagtcaagaactccatttttcaaattatatctcatgaaaagctggtgtccagtgacgtttatctgagaaaaagaaatttttttttggccaaaataactagatagatttttgttagactttataatgagaattatgaatttcctgaaagtgggatggaatacagaatgttccccaaattgtttccatggaacagctaatagcacatagagcatgcgtatttgctgtgacatgataaagctcaaggccagagatgtcttgtggggctcccaagtactctaacctcaaggtgcatgccctccactcactaattggctcctctggctgtgatcgagctccaaaagggaaggaggctaattcaaatgggatggccccaaaataagaggaatagtgtgcatttaaaccaggatatgggctatacctgcttacagtaccctttatgcaatctccagttcattaactctagtagatattgtgaagatactatcaaaaaaaggttatgttcccccaaattagggaagccctaagggattccgtatctcctttttgtacagagtttgttagaaaatcagatactggtctgagaaaaatgctgattcagatggtcaagagactaaaaaaaagtactttaaaacatcagaatgaaatcactgaaggcaatccttagctttatgatgtgctgtactcctggacaagatggtgtaagttgagatgatatgtcaaatctgatttttctataggaaaaaattgtactttagggaggtatagttctagccatgttcttaatacccaaaagttaatcagaattaccacaaatgatctactcattcaaatataagtagcccacaaataccatgttaaactttctaaatttgaattgtttaaaaaagcaaagttatagaaaatgacatttatgacccattatcagaagctttagatccaatattagaatattagaggcttttgtgctaaactcttttctttcttataaattctagcctttatttatctattttaggagggcatgtggcaaagcatggcagggaattctttcaaaagtggaatccaggaagaaaattccttgggaaactttggactggattctcaacaaacccttcagagagacttaaagccggtaaaagaccttttgcaaaagtgatccggggggcctccactttgtttctctggatatttctctgttgaaatataggtgtcaagcacgtcccattttagatgctcttcagacttcaaaacattaccttcctgctttcagggagccatttcatcagcttttgtactgtgtattcactgcagaccctgctgttatgcaaggtaccaccatggctaaaaattcacaagacgattcttagttgcactgattttttttttatttgatctttcacaatgttgctgcttccgtttcaaaaacgtctcaaagctttgatttgattgcagctggattcaaggatacccaaagccaagtttgatcctgaattccccaaatcaaaagtatttcatttcagatgtatgttctatacctggccataataatgaacagcaaccattactggagcatgcttttgatttttttttcattaacagtcatttttatgatttggaaacataattagaagattcctattccagactacaaatcaatggatttgattctactacacatttgccaataaagagcaatggtatcaaatgaagcatttgacctgtctttaaatttctttcattctgtaaattctacatgaggtatgatatatggagccaactggctcctctgccacactgctgcagttcagttgttggtattgtctggaaggaaaaaacgaagttgtggaagtgtgtgagttagttggaggtaattaccatgtaactgattatcattcatgttctgagcgctgtgctattacatacattattttatttcatccttgcaacatccttattcctatttttcagctaagtaaaaaatgaggctcagaatagtgaagtaattatccacggagagggaagatcagcagtatagattaagttggaataaatctaaagctcatcctctttcactatagcatgctgctttctagctatataagaaaaaaacctcattattctattaccccattgagaaagtactgttctctcttgttcagctgtctgctttacttagctccgatgaaatctaaattaaatgctctgctgctgatgatgttggtaacactctggtggtactaaccatagttctggggagtgaatgggaagaatggccaagactggagatggggacattagattttgagacacagaccaactgaaatgagactgtgttttctgttaataataggaatttaaatgaatcattgaaaaatcagagaaagttttctgaaatataggaagcaaatgctacctatacttctttatatctttcaaattaaaaaataattttcaatacatgttaaatggtacaaaaatcagtggggcttttttaaaaattcaagctttataagaaaaaataataaaacatgtgccaaatatgtctgaatactattaaatgtaaatggtgtatcattaaatgcactggctgtttgggagaggtgtaataaacaagagacacattgtagctatgaccgtgacgatttactttttttaattctggaggaaatttcaaactgtggaatatataagcagaaaggaaatgaataatgcatctaactagcatgcgatagtaagcctcactcccgttgtggacagacaatatacaagaaaagattttggtggaaagatgtaggtgctatttaaggggaggatattctttattgaaaacatatccagcaacatctgaatgccaaataaaagtctttacagtttcatctctccttagagagcatattttttagttgttgttttgtttgggagaaaattgcagtttaagatttacaaaccacttcatttgcaaactgctattactatagtttctgcctctgaaaatgtttaaagctgcaggcaatgaaaagacatattattagagcttttccttataaagaaagctctcattctattgtaaaaaatgagcgtataaaaatacaatattatttatagagttatttatataagcagcattttgatgtgccttcctgaggcttggagatattagaaagcagaatatctgagaaaacatatttcacttcgttgtttaaatgcaatagagatcaagagattatcttcatcatgataagattcaaagaaatttacactggtaattggagcttgtccatagaatttattccttattacaatatagactataggttgttacatttttttccttaagggaggtaaggttagatttttcactatttaggttgagactctttagttgataactgaaagttttcttttagcattcaatttgttcttgaattattttttatttcagcatatctttctaaaaattatgcatgatcagctcttttttttttccattttcctatcagctgtttatcttagatcttcattcatggatgtgttagtttcccaggattgccaaaacaaatcaccacaaactttgtgtcttaaaacaacagacatttattctctcagcagttctagaagccagaagtttgatatcaaggtattcataaggccaaacctccttcaaaggctccagggaaaaatccttccctgcctcttccatattctggtggctccaggcttttattggcttttggtggtatcactccaatctctgcctccgtcttcacaaggccttccattcagtgtctcaaatcaaatctcttttctcttataagaacaccagtcacttgacttagggcccacccaaatccaggatgattaattttgagatccttaacttaaacatatctgcaaaaatccaacttttcaatttccgaataagatcacatttccaggtgctaaggtatattagtcagggttccccagagaaacagaaccaaggggatatctaaatgacccttatgggagaccactagtgtcgatcctggttcaactctaaaggcctgaaaatcatgagtgctgatatctgagggcaggtactcagaaagaagaaatttattctttctccaccttgttttaaattcaatccctccatggattggatgattcgcacattggtgaggtggtcttctttactcactgtactgattcaaatgccaatctcttctagaaacacttcacagacacacccagaaatgatgttttactagctatctaggcatcctttagcaccatcaagttgacacataaaattaaccatcacacaggggttagcgtttgggcatgtattttagagggattcaggtgaatgtattacaagatgtgaaaaatagactttggagttaggcaaaactgagtgaaaaacatggatctgccactcacattgaggaattatgatcatgcccataattctttagagcacaagtttcccccttttaaaaataacgatattttaataattgtgatgatactagcttcacacatgttgtattagataatagcgtgcattgtaagataatatgtataaagcaattagctccctgctttgccaataaatggccattgttaatttattgattatatggattttatttttctaattagagtaattccattgacttcaatttctatagagttcttctttccttttatgcagcagaagttacaaaagagaatgtgacatgaatcatatctgtattgaaaatagacatacgatgactaattttgttctaaatgaagaatgttttcttatggaattattgtaagaattaaatggaaaaaaatgtatgtgaagtacttagcagttagcatttagtgttagctactattatcaacaattccctaaaacctgctagggttacagtaaccatggcaacacaaactctattttatttagtaatatatttatttgctaattgacaaacaaaattgtatttgttcactatatataatatattgttttgaagtctatatacattatggaatgactaggtctaggtaactaacatatgcactgcctcgtatagttatcatttttgtggatattttgcattcattctcttagcattgtttaagaatacaatatatggctaactatagtctctgtgttgtatgatagacgtctttaacttcctcctatctaattgaaatttcgtattctttgaccaatatcttcccaaccaccatccaccaactaccccagcccctggtaactaccattctattctctacttatatgagatcaactttttaagattccatttatgagggcaatcatgcaatatttgtctttgttcctttggttggtttgtttcacttaacataaggtcctccaggttcatccatgttgtcacaaataacaagatttcctcctttttcatggctgaatatagtattccactgtgtatacatacagcattttctttatccattcacccatcaatggatacttagattgattccatctcagctgttgtgaataatgctgcagcgaacgtgagaatgtagatatctctttgacatacagatttcatttcctttggatatatactcagtagtgagattgctggatcacttaggagttctgtttcattaatttttttttttttgaggaacctccatactgttttaaatactggctagtttacattatcaccaacatcaggcaagttctcctttctttacatcctcaccaacacttgttctcttttgtctttttgacgttctgagaagtatgaggtcatgtcacattgtagttttaatttgtctttccctaatgattagtgatgttgagcattttttcatatagctattgaccattttgtatatcttgtttagagaaatttagagtcatggctcatttttaaattgagctatttgttattctttgtttgttctgccattgagttgtttgagttccttgtttattttggatataaaccccttatcagatgtgtagtttgcaaatattttctttcccccattctgtaggttttctctttactctgttgattgtttcctttgctgtagaacagctttctattttgatgcagtcctatttgtctatctttgcttttgtcgcctgtgcttttgaagttatatccaaaaatcgttgctcagaaaaatgtcatgtagcttttttttctatggtttttcaacgagtttcacagtttggggtcttatatttcagtttttaatccattttaagcagatttttatatatggtgtgagataaggatctaattttattattctatatgtgggtatccagttttcccagcaccatatattaaagagactctcctttctccatggtgtgttcatagtacctttgttgaatattattagttataagtgcataaatttatttctggagttcctatcttgtctcattgttctacacgtctgtttttatgccagtgttgtgatgttttggttactatagctatgtagtatattttgaaatcagggagtgtgatgcttccagttttgttctttttgctcaatatcacacactcctttctaaacctcatcatcgtttagggtatataatacaattaataaatgcatatataattatatgtcttttcaaataattgataacctaaacttgataaccaatcatagttttacatactaactggcagttcctttctatcttgccctgaatcttattttatagacatacatttccaggatgttacatgagccttcagtttagctcatcaatactcagctatccaaaattcctcattgccttgcagcagtttttcccaataccagggccatgttcttagctggctttgaaaaatgttttgaagaggcatcttctccagaaatcttttgagactgatctccccaaatatgaatggtgctaggattattttactaataattgaaccttctaatgcttttctctttgttattgatttcttttgtggcattaatttttaaagtgcttgatttcccagttgattatttgctatattaatcatatgtctttcaaggtcttggctttgttaatactgtcttaactgactacagaatgaagacttctaactttcaggtaaggattccgcgttttttattcaggacaggtccaaaaaatggcaagataacagcaaggggattcatttgcctgcaggcagtttggttaaaattctcccttagttctcatatacacattataatttgcattttaattttactgtcttcacaaccacgaaagcatatttaggtaaaagtgctaattagatctttgtaaacaaccatatgttattttggtttatgaaatttaaagagcaattaaaaacacatatatttactacttataggtgggagtgggaatgactttaatctgaaaagtgtaagtgaatctgaggaaaaagctaaattagagatgtgttgaatgatcttttggaagaaactaaaagaaatttgaaacttttcttcagaaaaccatagggccacacaatgctacacattgagcctcaccataattaaatcaaaatacttgaaaattatatttcaaacctcttttcaactactgtacttaccttagagaaatcttcaaaagaaatctgtggtatgtttattgttaatgaaagcatgtcattctttctctggtgacttatccgtctttatcagtttcactgtgaagagcagagtgatatatgagtgtgataacttaagatgacatcttatagtgcaatccattatctgaaagatttaaggaaaaagctctctgaaaaaacataattaagaaaataaatgtttttagaaatataataaagatcttttatggttttggttcaggaacatccatttctataatatgatacactaaggaaatagtctgccaatcatctaaataacacttgtattttgatttttattggtttggcttctccacaaagaaactaacaaatcattaacaaggattaagaacaaaaaagtgtctaaagtttttttagaaatggattgaggaagtagattaaaaggagactcagagaaaagagactgttttctaaaaatatggccacgttgtaaatgtgtgtttattttctcaccaataaaaataggcaatatgttgtttattgcctggatagttggacttgacttggtttttggctcctgatttttggtctgagtctaatgaaccaataaaaatctcttgatgtgccacataagtaactcccacttgaccccattccaggagctaaagaatctcatggcttcaacaaattctcctgaaccttgctttggaattatattgtttatttgtaatagttattttctctttgccttagttgatttaagaagtctagtatcacgtcaggatcataatatatagatacagaactccttaaaaataaaccccaaatctaaaatcaggattgaaaaaaggacagaagtgaaatcaaccaaagtaaatgtttaaaatatgcattcttagctgtgcttattcaaattggtcaactctgaatatcttcgtttctttttttttttaattccactggttacagattccaaatttcatccattccttcttgccttaaactgtgatctgtaacctgtgccttcactcaaattaccatttcagctcttttacaaacatcaaatagcaaagggcaatatggatattttattagacttgcacagatcagaaacaaaaaatgtgcacacaggttcaggggactatgtgcagcatttctgtaaggaaatagtgggtgtgaggtatagagagaaaactttcccatcatcaagttcctggacactatggtactgcacttgtcccactataattcctttaaagtatagcgactacttttcacctttgtaataactacggtacttctaaagggccactacaatagcaatgagaatatcatctgtttttcttggaggtggtagttttcatcaagcatatcaagacatatgagaagatggtatttaaaatattcagccaacaatatgtcctgggcatggaccagaatgaacactggccgaagtgctaaagcaatatattggggccccggctgtttctgagatgtggggacttttgtgaggtctaccctagtgtacacccggagtagattcaggaaacctaagccgttgatgtttaccagttatacaaaagtatttcaatacctgaactgctgtggctataccagggcatgttcactaaatatcagccatggactttgcaaatttaagcaagcagacataaaaataagtcatacagtcattctgatgttcttgccattgcacatgctctctctctctctgtctccctctctatatataatttattatacaatacattataataaatagtatgtataataaatagcataaactaatacctacaaaatatataataacatattagtcatattagacatattcttatacccaattaaatttttattaatagaatagacataaggctggagtgcaattaatgcaaaattaatatatacgttatataactcatgtataaagacagaatatttaacattagaatattttgttattcttgtttggcattgctttcaaagtccatttctgttccacataaagaaattcatttcaggttttcatagtcgtaacccacatatttgaaaggggaagtttcatgtgtatgagatcatagaccaaagagcatatttgtaaccatcattggttgtttttgtctgtttcatttagtttttatagaaatagaacggatttggaagcttactgtaaacactgtgaaatggtgaagacttaagaagcttttcttaaatctctaaactgctgagagcgtcctagtatgacaaaatggtgccgtcctttagtacttaaataaatatcattcttcctgaaacactacagttaaactcagtgggtcacttttgtgctttggggtgtaagaccccaaatattaacctgaggaacctaaaagcacaccagaactttctgaaactttttcccccatgctagatggggtttggtctaggagaaaagttttgcttctcttcccagtgggtcttgttttagaactctctaaagcaatgagcttctctggtttatcttccatcttgtttattgtacctagtctctgacatgcagaaatgacttaataaaggttttctgaattcgtgaaattcacctcctgaaaattaccaccttatgatctgaaaaaactatctgctcaacagaaagttactcatatatctgcttctatagatacagtagtctcccttacccatggtttagctttctgtactttcagttaactgcagccaactgtggtctgaaactatcacagtattttgcaagagagagagagagagagactacattcatgtaaattttattacagaaaacatggcatatatgggacttagtgctatctgtggtttcagcatccactggggtcttggaatgtgtcacccatggataaagggggaattactctgctagatttggtaaaaaggcagactagtggagagatcttctgaaaaaaggagataggaaatgttactgaagagaaatagaaaatattgtattaatttattaaaagtaaaggttattagaaggtattaaatttttgatataatgtaggtgacagtgtgagtggggaaagacctgtaagtgcaacaaggggatgaaattccctatcttctagccatactccagtacataaacggcttaaaaataatgtatatcaaagcaatgtaataaaggattaccgtgatgaattttatgagattaagctgcagttaatttccttatgcatttaagattaataaactgctaattagaatatgcaaataagggtttctgaagcctaaaatatattccctagcatcttacccataaatcttattcagtaactattttgttatataattggggaataacagattgatgagccaatctaattatgtgaaatttacatgtgtatggtattttataataaaggacatgaactaatgttaaagtagtggaaagtagttgtaacattcattatagttattaattacaaaatttaacttagtttgaaagtactttgtgccatataagctatcagccacaccaagtactcttactacacatctggtgcataattgtcgggtgagactgagcccatcagcaattacagcaattattgggactcttacatttacagctcacacacatcacacccaagcacacgtttctggaatattgctgatcatccagggacctagataacaactaattgcctcattatgcaaagtggggaaagatattcgtatttcttacatcttctgttctacattatacacatagagatgcctgtttgacagcaagcaacagataaaagaatattagaattatttttgtgcccagttaaggttttttgggtttggcttcgactttttcataaagaaagcatcttcatgaggctggaggacataaagcaatttgaaagctattatgggtaaaaaacatctaaagggtttacacacacacaaacacgatgaaggaattaggaagggctctaatgatcctactatttactactttggcaagataccaaatggaataagaattaaaattctattgaaaattaattcaactgagtggacagaatgctatgaagtattcggggcattttctttcatataatatataacatttactaatatgttcaagtaacaaaagttacctttatacagttcacctgtactctgtgtatttgtccaacattcccatgaaggacaaatgtaattaatcccaatttaaacaggtaaaaaatgaaactttgatatatgcaaactgcaatttgtaatcaatagtgagaaaatggaaactgcagcctttgcaatccagttctgtgttctttatacctgtgtattgccagatctatgtgtgtaaataaaattcaacaaagaaatacctgataagataagttttgtgggcatttatagcacacttagtgaaaatatataatatcaccaagcccgccatattagaccacttttaccttatttttcttactttaatcaatatttcattaaatttgacttaactttatgtgtaaagatactggtatgaacaacaattaccttgtccatattattatctcttccagctttttcagagcagtttgaacaaatgaataaaaacttgagaaacataaaagatgcctaactaatacatatggcacatgcattataatattaaaagggaagaattctcaacttgttatgtacacactcaagcttttttttttttttttgagtattcaattagcagaataaccctacagaatccgtcaatatcctgtcttcactgtgaacagaatagaaaattcctcttcttttttttttaatgactgccaaaatctagggcacttggtgttgatgcatgactaattactaatgtttcaacagagtaagtcagattcaaattgtaaaggcacacaagtgaatttaaaacctactttttcattctttgataatttctctaccaatggaggataagaagagatgatgccggtttgaaattcctgacaaaaacttaaaactgcttttaccctgtctggtatactattattttattctaactgtgagaaaagtagtaatgagatcatcctatttcaactaccgtgactttaaagagaacatgacagatacaatttttcaacaaattaggctgttttctgaaatactaacaaagtttgccttttcagaataaaatgttacaagagctgcttctggccctaatgtgcccttatcagcgtgtgtgtttttaatgtggttaaggtttaacattcattccagcttcacctatagcttgttggtatgctttatcaccatggattttaaacacactgaagaaaataatttctacccccaaaattattaaagcccctacaaggaactttacactttcaaaaaaataattattttcaaatataaacacctctttatatcttgacttttagatccctataaaagccaataagacaaatttgattcaatgggaattctttgtactggcaaaaaatattacatgaacgataatataggagaccctctgttatgtaaaattacgctatttattactttagcaagttccaatagaataatcgttgatggccctgaggtgtcacatgatcctgaattacttaattgttacatatattcaggaaaataataatgttaactgcatcatgctctagtctaagcttcaagaaattggtaatacaaatattctatataatctagcattctacctaaatatttgatcatttgtgacaactacattgaatgagagtttaccatacttttttaacaaaagaaaaaatatagcttagttagctattgatgagacctactagaagaaattaaaactcatatcttatgatttatcacaaagcatttgagcacaaagcatttgaatttgatgttaattcaccttggctgtgactcactgagaattctgggttttacagatgggtagatcacttccttttcatgtagctttttttaatattgttgacataagagaatctgaagtatcatttcttcacatcctatttcacctgtcattgtcatctcaaaaatctattttctcttgcataaaacctcagtgtttaaagctataaaagcaaacacagcagtgaggaaattttcccctgggtctatttgccatatgctttaaaacagaactatttgaacaccaaaatcagcattcctgaacttgcgtatagagacgtttgttttcttttcccacctgcataagggtaaagaattcaggcttgcagaatatcctttgaattctaaaaccttgctgaaaaatcatttttatactgcagagtgatgactcttgctaccttcttatgattggaagggtttccaagagaaacaagatggacttgacttctcttggaaatataactcagagtgtttgagagatttagaagttattcttctgttactttctagatattcacttttaattataagtaaaatatgtttcagatccaaacaatggtgacttcattcattcattcattcaaaaaatgagtgtattatgttttcactgtgtttccttcacagatattcttggcacatcagataacacagtgaaaaaaaaacagatgacaaatcgtcaccttctaaagcttatattctacagggggaataaaaaaacagaaacgtatacatacacgcatgcatatacacacacataaatttaatagcatgacagatggtaatactgctatggaaaaaataaagcaagaaaaaggaatagtgagtttaggatgaggtttggagggttaaaatttgaacagaaatttgaaggagatgagagtacagatatcatgctatctgtggggaagattgctccaggttctaggactagcaggtataaaaggaatttgctggggaagagcacggaggaccatgtgtccagaaagagaagttaagtaaccaggagtgaggggcagacttattgaggctgtgtgcaattaaaggggatgttgactttaagtgagagggagggccattagtggcatttgagcagagcaatgaaatattctacttaaaaaaaataataagctaactttagctgctatacacaaggaagcagaggtgccacttaggagattattgagtattttaggaagagatgagagtgtctcagacctgggtgatagtgatataggtgatgagaatcagacagattctggatatagtctgaagtttgagacatttggcttttgtattcaatatgaaatatgacagaaaggatgagttgaaggtatttgatttgagcaaggaagaagttgcatttattaagatacaaaagaatgcagaaaaagaaggcttgggggaaatgtcagaagttagctctagactcttgaagttttaaattcaaaataaatatccaagtgagtactactcaatctattgagtagatgattgcatatctaagtttgaatttcagagaagaggtgtatactataaatatatatgtggattttgtcagtgtggaattggtatttaaatccaggggtccaattaaaatcaccaagagagtaatgtagatagagaatgggagatgtttgaagactgagccttgggatatccaagactcatagtttgtagagatgagaaaaaccacaaaagaagactgagaaggaacagccagttaagtaagagtaaaatcagaagagtttaggctgtcctggaaggaggactgatgtttctgctaaagtgatgcaatgatattgcaaatgtaatatacttgaaagacaccaagaggagaggtattggaggcagtacatttttgcttaacaaaaaagcaagggaaaaggacagtagatagagagggatagtgtaaaaaaaaaaagctgtataatttttaaagagagggttattaatgggtacaaatttacaattagctagaactgtaaataagacccattcaatagctcagaagggtgactacagttaacatttatctattgtatatttcaaaataggtaggagagaataaatcaaatgttactagtataaataaaagataaatatttaaggcaatggatattctgattaacctgatttgacctttagagattatatacatgtatcaaattatcacttgtatcccaaaaatatgaacaactattatctatcaatttaaaaagttggctaaaatagcagtacttttgttggaatgaattcatagaaaaataaatgataatgtatgtgaatgaagaatttctggagaattaaatttctgcaagtaatgatggaatatagtatacaaatgggtgcattgccttgtatacaagtaaggatagtttatccagagtgataggagaggtctatgggctcattcacaggtcagtctgtgaatattgtgatgaaggctttgggatattttttctgattcttttattttcttaatgaagtaagaagctgagaatgagaaagtgtagaagcttaagaaggaaatgttaggcaatagtaatcaaggaaaagaaggagagtgaatgaaatagatgtcagtagtagaagggcagatggcaacagaggctcacatgggtttaagggtcatgaagaccatgcttcatattgttaatgtttttctagagccatatttgaccatgggtaggaggagtaatttaaccattgtatagagattctccaactgtatataaggcagcaacagagtagcaaacacaagtaaataaatgtaatgaccaattatgggggaggagcaaattaagagcatgaggaagagagagaaggcaaggggcagaatcagtacactgtaagttctaatgctgaagttagggtactaagagtgaactctcaccttctctatgataacatccatatttacataaaatctgtacacaaacattctgatacagtatagcatcttccattttccattgagaatgattctcatccatttgtgctattcccattttgcaaggaggaccttcttatgttgggaaattttaatgattataaatgctctgcatataatccctgctgacggaatctatgcttcattgatggatgaatgtactcaatcatgatgcggaagagggctacatggtaccttccaccaacagctactttttctattcctctctctctctctttaaatattttgcctttaaaaaatatatcttcttaccatttgacgcattcctgggaaggctgttcttatcagcagacattgctggaaataaagagagaaattgtagaaggaagaccagttattaaagaacaaaatgtcgatagccccaaagagaggtttaattttaaaaagcaaagctaaaaatagcaaaaatagaaaaaacacaaacaacaaaacctctaaaactctgaaatgcgtgaaagagtacttttcaaatgcaagcatgcatgctaacttcacatttccacccctacttatctctcccacacttgagcctcacagctcacatagccgcctttctcctgagtatgacagctcaactcccagaacagcctatcaggtcacaaaccataactgatcatttttgtgtgcttcttagattctgtttgcctggaagcagcttttcttttaacattatttttctcctacagatggaaatggaagagaggagaataaaaattcaagtctaagactgagaggttccataccagcgagcctggcaccaggttgagcatgtatcatagggaaaagttagagaccacacaagcctctgtggttatactatgctgcagagaagagggcaaattaaactggaggtccaccttacaagaattttgtgaacagctgaatgttataactgttatgaatacctgcatcacctaacttaaccacatgaaactcactcgtgaattccctactgtacacatgtcagcattctgaggttttagtgattttcttaaacaccagaatactaccaaggggtcactcaaaatgcagtgctgggaatgttgtaagaaacagttattccccttatttaaccaaattttctgtcacaagctgcataattccaagtttctggatcttatttaacccttggggaaaaaccagtccttgaattaaaattaaatataacattattcctgaagtattacaggattttttttttatttcttgaaagcggagtattcataattactacttttttttttttttttgagacagcgtcttgccctgttgcccaggctgaagttcagtggcacaatctcagctcactgcaagctccacctccctggttcaagtgattttcctgtgccagtcccctgagtagctgggattacagttacgcaccaccaagcccagttaattttttgatttttagtggagacagggtttcaccaagttggccaggcttgtttgaactcctgacctcaagtgatcctcccacctcagcctcccaaagtgctgggattacaggcgtgagccactatgcccggtctcataattactttgatctccctctcatataattaaagaaatcattctatcatcttttctatcacgttattctctttacacatttgtccgatttctttctgctcctctgtagtgacagttttaaaatcttcatttgttattgcgttattatatactgatcaaaacaccaaaatatactttgtgctaaacatttcattgtgcactatggatgattacaaaatcaagtaaaaacacagcttcagctctgaaggtatgatacagataaataccactgtgaaaattttgtgtgattaaagataagtgagattattgaagaaagtaggttttcctagagtcaggatttgaagtaggggttattcacagaaagaataaaaaaaaaatttcaaattgcaggagacagtatgcagaaaagctggatttgaccccgatgacttgtccccatcccttttatttcagcaatattttcctttcaactaaagcaccaatgcaaattataccagttttttctctctgtagattgtgtggcttgaggaactacggtgtaggaaccaatcagtgccaagcctccctccccaaattccgcctccagtctcccttccttcctttcttcctcattgtctacagagggtgcccagaaaagaatcttattgcctccttttccaatgatttacaggataaattccagatccttagcatggcccacacttttctctgtgttgtggccctgtttcactaacgttaccttgctcggctggcagtttcatttctccaaaatgacttttttccctgtccaccaggcaaactgcctaatatttcaagacgtaactctgataccaccttctatacaaagtcttcccttaggcaaaatgtctaatcttttctctacttctttaaaaccaaacaggtttctttcattttattgcatttctgtgtagctttcctctgagatttttgaagtcaggggctcttcactcagcattacatcaatacatcattaccgaccaatgactatatctcagacattgtaccaggcatttacgatgatggtgaccacaatcatacatagactcttgcttcatgaagtttatcgagtaacaaaaaaggtatccacaaataattacacaaataattaatcttaatatatcataaaggaaaattacacagcaatatgaaaacagatcaaggagagcaaatagattctggactgttggggtgggaggcaatattaggagtcacagtttttatgtatatatgcttttcttttgataaattagaatcatttataaaacttttaaagtttttctttcaattatcattgtatatttgaataatacaattaatcatccactttgagttgtattgaccttaaattgtgtattttgattctccactgtacagatgaaaaaattatattgtatttgcaatgtaattattgcttattatacttccccctactctgcctcaaaattttggttagttatattattatttcagcttttctagcagttatctttatatagcggtgaacttgtgactggcttttaagtccaaatccaaaataaattttggttgataatttgtgtctgttaatgagtaaaacaaagggaaaacattgaagatgaatgtcagaacttcactcattcatcaaagatataaatgacttaatcatagatcacattaattcaattggattaatttgattaattaattcaattatgattgcttgatcatagattaggttttaagttctgaaaaaagattttctcaattttttgtactattctatatgtaatgactgtaggcacaacacacttttaagtttcatctgtattattaacattttttccgttctctcttcagtttgacagtcaaaaaagcagtaagtcaaaccctgatttgcagcatttgtcaatttccatggtataaatattccctgtgtggcttatttaaagcttccagcctaccctcatggaatgcagagaagagcacagagagataatacatgttatttgaaagactcaatattatcacaatatctactcttcctaacttgatctacagattcaatgcaatccgaatcaaaatctgagtaagctattttatgaatgttgacaaagtgatcaccagcagcataccacaatgtaggatttcccccacacatttgcggtgtcaagagcatagatactagtaaagtgtagtaaaatccgttaacttatttacttgcaaatgtatatgcttaatattttcaataagctttattttattatcagagaagttttaggtttacagcaaaattaagcagaaaatatggagtttccatattccctcatcttcacacatactcagactcccctactatcaacatcccacaccagagtggcttgatttgttacaatcaataaacctacacagacacatcattatcaatccaactccacagtttacattagggttcacccttgctgttgtacatgcgtgggttttgacaaatgtataatgacatgtgtctactactgtagtatcacacagaatgttccactgccctaaaagtcctctgctctggttattcatcattccacttctccagattctgacaactattgatctttttactgtttccatggttttgccttttccagaatgtcatatagtctgaatcatacagtattgccttttcaaattggcttctttcatgtaataatatgcatttaagcttcctttgtgtcttttcaaggctcaatatctcatttcattttagcattgagtaatttgtcattgcaatgtaccacagtttatttatccacttacctactgaaggacatcttgattgcttccactggcaattatgaatgaagttactataaacatccttgcacagacttttgtgtgaacataagttttcacctcctttgggtaaataccaaacaacactattgctgtatcctatggcaagaggaagtacaggtttgtaacacactaccaaaaactatcttccaaagtggccataccattttgcattttcaccaacaataataagagctgtcattgcttcacattcttggcagcatttcgtgttgtcagtgttgcagattttggccattctaataggtgtgcagtagtatctaattgtcattttaatttgcatttctctgatgacatgagcattttttcttatgcttatctgccatctgtatatcttctttaatgaagtagctgttaagatacggaccatttttaattgagttgttttcttattattgtgttttaagagggcttttttcggtatagtttggatgacactcctctatcagatgtcttttgcgtaccttttcctctagtctttgacttgtctttttattctcttgacatgctccttcacagagcagaaaatttaattttaatgaagtctagcttgccattttttccctaaagtgtgccttagatgttgtatctaaaaagccattctgacaccataggtcgtctagattttctcccttgtcatttctaggagttttatagtttagcattttacatttaggtctataattcattttgagttcattgttgtgaggggttcaaggtgtatgtctagattatttatttagttagttagttattttgcttgtggatatccagttgttccagcctcctttgttgaagaaaactatcttttcttcattttagttccttcgtcaagatcacttggctatatttacacagatgtattcctgggttctttgttctgttcagctaatctatttgtctaatcttttgccaacaccacactgtcttattactttagttttatagtaagtttaaacttggatagtgtcagtcctccaactttagtcttctttaatattcttggctattttgggtatgttgcccctttacataatctttaaagatcactttgtcaacattcacaaaatagcttgctcagattttaattgggattgcactgaatctgtagatcaaagtaggaagagtagatattgtgataatattgagtctttcaaacaatacatatcagctgttcatttcgttctttgatttctctcatcagagttttatagttttcctgttatagctcttgtgcatattttgttagtttatttctaggtatatcattttcggggggcgctgatataaatagtattgtgctttgaatttcaaatcttacttatttattgctggtatatggtaaagtgattgactcttgtactttgaccttgtatcttgcaaccttactacaatttcttattaactcagatagtttttttgttgttgttgttgattctttcagattttctacatagacaatgatgtcatctgtgaacaagcacacagttttatttcttcctctccaatatgtataccttttcttttattttcttgtcttattgcattagctaggactttcagtacagtattgaaaagcagtggtgagaggggacatccttaccttgttcctgatcttagcaggagaacttcaggtttctaactattaaatacattagccgtagattttttgtgaatatattttatcaagtaggaagctcccctttattactactttattgagcattttgttatgctttgttttttaatcatgagtgggtactggattttgtcaaatgctttttctttatctcttgatatgatcatgtgatttctcttccttaacccattgatatgatggattacattaattgatttttaaatgttgtaccagtcttgcatatctttaataaatcacagttgttcatagtatacagttctttctatacattgctggattggatatgctaatattttgttgaggatttttacatctatattcatgagagataatgatctgtagttttcttttcttataatgtctttgtctggttttggtattcctcaaagtatgagttaggacatattctctctgcttctaccttctagataagattctagagaattgatataaatttcttctttaattacgtggtaaaatttaccaataagttgatctgggcctgctgtttcctgatttagaaggttattaattattgattcagtttctttaatagatacaggcctattcagattgtcaatttattctcatgtgagtttttcaaagaattggcccatttcatctaggtcatcaaaatagtggatttagaatttttcacagaattcatttgttattcctttaatgtccacagaatctgtagtgatggcacctctttcatttctgctagtagtagttgatgccttctctctccttttttgtcagttatcctggcaagaggcttatcaatgttactgatctttttgaagaacctgttttcagttttgttgattttctccatcaatttcctgtttccaattttattactttgtgctctaattttcattacttttttttctttgcctactttggaattaatttactcttctttctttagctttttaaaaaactaaggcagaagtttatatggctgattttagatctttttttctaatatatgcatttagtgttacaatttccctctaagcactcctttcactgcatcccacacattttgataagtttggttttcattttaatttagtgcaaaagatttttaaatttttcttgtaatttattttttctaaataacacatatcttctttagaagtgtgttatgtgatccccaaatattttgaaaatttccaactatctttcttttattgatttctcacttaattctattttggtctgagagcagacactgtatgatttgtattcttttaaatttgtatgtgttattacccagaacgtgatctatcttgttgaatattttatgtgagtctgagagcaatgtgccttttgtggctgttggatgaagtagtttataggtgtcgactgtacctagatgatctagtgtttttgagttcagctatggccttactgattttctgcctgctggatctgttaatttatggatgaagggtatcgaagttgccaactataacagtgggacttaatctaattctctgggcagttctatcaatttttgctttaagtatttttacattctggccggcaccgtggctcatgcctgtaatcccagcactttgggaggccaaggtgggtggatcacgaggtcaggagttcaagaccagcctgaccaacatggtgaatgaaacactgtctgtactgaaaatacaaaaaatagctaggcttggtggtgcatgcctgtaatcccagctactctggagactgaggcaggagaatctcttgaacccgggaggcgaaggttgcagtgagctgagattgtgccactgcactccagcctgggccacagagtgagactccatctcaaaaaaaataaaaaactaaaaaatttttaaaaagtatatttacattctgttgttagaaaacagacatatatattaagaattgttatgacttttggcagggaggattgacccctttatcattatgtaatgctccactttcctgacaaattttcttgctgtgaaatctgctctgtctgaaattaatacagctacttccactttcttttgattcatgttagcatgatctatgtttctctatccatttatttttaatccatatttgtctttacatttaaagtgaatttcatgtacaacacatattgttaggttttggttttttattcagtctgacaatctctgtcttttaattggggaatttagaccattgacatttaaggtaaatatcgatgtagttcaattaatatctataatacttgggtttggttttgattttttgcccttgttctttgttcctgttttcatctttcacacatttgctgctttttgtggttctgaggattttatatgactctatcctctctcttttcttagtgtctcaattatacttctttgtttttacttcttaagtggttgccctagggtttgcaataaatatttgcaactaattcaaatctgctttcaaataactgtcacaggtagtgcaaatactttataataacaaaatattttgaatccctcctccatatacatagagtacattattattattatcatgaacaacctgttgtctgttagataaattaagaataagaaaaataaaagtttttgttgtgtcttcccttaatcattctttagcgctctccctttatgtagatctagtttctgacctatatcatttttgtttcctctgaataacttcatttaacattttttttgcaagtcagatctactggcaacaaatttcctctatctttatttgtctgagaaagtccttatttttccttcacttttgaaggatagttttgcagagtgcagaattccaggttggctgattttttttttctcccaacaccttgaatatttaactctactctcttcttgcttgcatggtctctgaggagatgtcagacgtaattttataagtgaagtgtttttccctccctctggcttatttcaaaattttttctttatctgatttaatgaggtttgaatatgatgtgcctaagcatagtttttaaattttcattttttggcatttatcctgcttggtttcctttgagcttcctatttctgtagtttgatgtctgcaatagtgactgagaatttttccaaattaatgtgtggtttggaagtttctgttatcacgtcctcacactcagagattctctcttcaaccacattcagtctactaattaaatgtcagtcaccaaagccattcttcatttctgttaacagcgtttttattccttagcatttcttttttgttctttcttagaatagccatctctcagctgacattgtttattcgctctgacatgtcttttttttcctattaaagccttctagcatattaattatactttaaaaaaattccttttctgataattccaacgtccctaccatatctgactctggttctgatgctaattcgatcgatctcgccaactgtggttttttgtttgttgcctttattaatgcagcgataagtcatgaggatgattttctgataatttcaacatccctaccatatctgactctggttctgatgctaattcagtctccaactatggtttttgtttttttgcctttattaatatagtgatacgttgtgggggagcggggaagcattctatgattaggtctcagtcttttggtgagcttgtgcctctgggctatggacttcacaagtttccgccaacccctttacgtggcacagggtgactggaggagaccacagctgtgcatttcccctcccctaggtaagtgaggctctgatacaacctcagaagattcagctctggtaaaatagtttctcctctgggtaggccttgttaagaagaacggaaggctgtgatgtatttcaaaatggtaacatttcctttctccctactagaagcaaaagggactcttttccaatatttactgtgagaagctggcagactcctggagaggaaacttgtagaagtgtgaggaccccctatgactgagtgccctggagttttcatctttcaagcttgtccacactcaacctccagaagttcgttaattacagtttagggtttcctaccctggtactggctcataatgagttttctgctcatggatttctgtttggttattaagttgtaattttccgtgtccacctgtctatctctccaatgttgccctgtggtttgctctatgagtacccttctctgatagattcaagaagagttgtaatttttcattttgctcagatttttacttattgttaggccagactgaagatacctaatctccttacatgccagatcagaaatcaggagtttatactttatttttcagttatggctttatttaacaactggtttgcaaatttcctgaaaatttaacagttgcctcttgtgagtttggggtgggaaagagaaggggctccaacacaccactacctttataccattacatcacatatttaaacatctattattgatagatttgttttaaaataatgtcagttaccaactgtctattaaatatgaaaaaaaatcatttcttctttcttcttcccccatccacacttaagcttttcatttcactgctacattttattatttaagtccaaatgacaggacttttttttaagacatggtcttgctctattgtcaagtctagagtgcagtagcacagtcatgctcactgctgtcctgaaccccaggctcaagtgatttccccacctcagcctcccagttatctggggctagaggtgtgcaccaccacactcagctaatttttgtatcttattttgcagatatggggttttgccatgttacccaggctggtcgtgagctcctgggctcaagcagtaccctgcctcagcctcctaaaatgctgggattgctggtgtgagcacattattgaataatatcagaaatactaaccaaaataattagaaaaagtaaataaataaataaataccttagaggaaaaaatcaacaacaacctttcaagtgaaggagtgggacagatctttctaagaaggaaacagaaatcagacattataaagcaaagattgaccaatagaactaaagaagaacttgataaatttgactacatgtaaacactaattcatatgagaggaaaaggggtagtagtgcccttaatacatgcttataacttaatgtttagattataacgatttaaaaaaagaataaatatatataaagggttatctaggtgacttaagcaagctgaacgggttggagttcatgcctcatccccactaaaattctattaaaaaaaaaaaaaaacgctttttaaaagatggctttcataaaaaggaatgagttcatgtcctttgcagggacatggatgaagctggaaaccatcattctcagcaaactaacacaggagcagaaaaccaaacaccacatgctctcactcataagtgggagttggacaatgagaacacatggacacagggaagggaacattacacaccggggcctgtcgtggggtggggggcaaggggagagatagcattaggagaaatacctaatgtagatgacgggttgatgggtgcagcaaaccatcatggcatgtgtatacctatgtaacaaacctgcacgttctgcacatgtaccccagaacttaaaatataataaataaataaataaaaagatggctttaatattacagaaaaatcacgaaggtagtttttcattttatttttaattttgtattgatgtgaaagtcacaaaatataacattaaccattttaaaatgaacaattctggggcaattagtgcacgtatcatgttgtgcaataaccaaaactgtctagtcctaaacatttcatcactccccccaaaatttctagacccagcaagcagttactccccactcccagctccttcagttcccagcaactgtcagtctgtcttcctctctctgaatttacctattctgaatattttatataaatggaatcacacaatatgtggctttttatatctggcttcttgtacttagcataatgtttttgaggttcatccacccactcttcttaatggcttttcaagttctcacactgacaatgtggaaaatgtattattttcctgctttattcatagcctttctttgcttttcactctctgttggtaatgaccagaatcatacctagtcctaagtggggctgaaatttttcccttcgaaggctttttctttcagttccctagttgtattaaaaaagtaaacgtagatatgtagagtaggtactgatatcagtaaggatatgatgctataatttaccatggattaaaatgattcagaaaaattacccagggttaagtatgaattattaacatttagtgaaatacagcttggggccaccagtgcactgttccaggagggctgttcacatggaggcccacagtcatagaaggtgacccaggtgcgtgtaactgcaccagtccattcccctcatgattacaactattttactttattcaactaaattttatacctatccacttcaaattcattcccagaaattgtactcaccatttgccacttttattctcagaaggtaagaagtttaaaagccacaaaacgtatgcctaaaagatgaaagaatggagtcacagtatgagtgctaaattgaagaaatatcagaaggaagaaatgaaatcacaagtaaagtgattgaaacttggaaacttattggtgttttatgaggagacacaattgctcccacagtgctatactgaagaaagtgccagcctccaaatgaaaagctgatataagagtggtgtgaaaccagtgttaagtattttgcctggaagaaattgcttagaatgagagcagtccctaaactccttagtatcatttagtatgtttacttataactattactcatcatttggcccgctgggtctccttttgtactggaacagccctgccaagggactccctgtcgtggactaattctggagagtggaacaccgctgggcagggggtctctgtgctgtgaaatctgaagctaagaggatggatggcatttagttgagtgcattcctccacggatgctcatttaatttttaaaaatgtctctgaactgctgggacggttcttcctggattttttgtagttctcttcagttacacacataactccttagagatgcattttgctagtgaggtctttcaatatgtcaggctcttttcatttaagcttagacattttagatgttggaccattgtagctgaatatttctcttcccttgccttcatgtaaaatgaccctagtgtaaagtataaacctggtttgtttgcaaggaaaatgcactcttcagtttcatgtttctgggtgaaggagtctgtcaaagtgctgcctgtcattactgataactgcagtaggtcagtttgctttactgtaacattaatttatcatgtgacttgtatcatgtaagtgtaagaatacagccaataaaagccataaaaataagtcaactgctaagagatatttcaatttttttagaaattcgctgggtgacttgtcattgatacattttattaaattacatatccaaacagagtatactgtgaagatcaggcgagaaatttgtcttctaacggcttttttcataatttccattaatccatattgtatttggtttcttactggaggctattttaagtagtcttttatcagaatcagagattttatactaatcctaccttttagttatgagcatttagaatattcgttaacaggagttgtaagttctcccaactaaacagacgtggtatattcagtttaacacagagcacatatcagaaaacttcattctagttataaggccgaacttcccttaaacctcaatatcatttgatcctcaaactaaaatcttttgagactaccagctatgctatgctttcattacggtgcggaaggaaccctgttagagacacagtatacctaagttttgggtccagctctctctaactgcctgcatgaatataagcttgttattgaacctgtttccttaactgagggaaaaaggatttgaagtagaacagtagttcttaaccaggagaccatcaaatcactttggttggttttttttttttttttttttttccgaaatatacttgtccatatctctctggcatccttcaaccccattctgatgtaatgaagctggggtggttaatttccagttaagtttgtcttggagagatgacatctctcgtcggatccacctctacaagatatgactctgaaatcacaagagctggggttgcagaatttgcagcagcaattgtatcaatggcatcaatattcttataaaaagtgtttatatctagttctagcaatgaaagtcttgaacagactttctgattaaaatcagaaaaaaatacaactttctgattaaaataaatgggttagctgtttcccaatctgttatgacaacaaacctatttctggaccaaaaatcttgatgtgtaatgtaatgtaagatatggtcccacatatgtttcagtaagaataaagaatatttaaaagtatagtggtcctcactagacttcttctcggtgggaaaattgtacagaatgcgagttctgtaacctctgcttcctttagtaaccccacctgagagccagaagaccaacagttcagaccagaaaaagtaatagaagcagaacttccggaggcttgcagatggagtgttaattggtgatctgaaaaaaagtgcttcatctctcttgtcgttaatgtttgggtctgcaggaaaggctgacttcatgaacatgtggcctgtgtagccacagagggccccaagttcagaaaggcctcgtgctgttgtaatgctctgctgtgatggtcttgaaatccttaatgtttttaaacaagggtcctgcattttcattttgtactgggctttgcaaattaggtagttagtcctgcttgtagcaatgaaactaacaccccctgccccggtaaaaccaagcagttcctatcatttttctgcttctttacttttgcctttaaggatcacttgttatttacattgttcaagcaatggtaagaagtgtcactttccctggctgcctcccacacttgaggcgcatagcaagcctgtcctcttcagttctgatgacctgcccattctaaccactgcgcctgtttcctgaacccttctccatacaccaaccacattaccaacctccccttcccatcgagagaagacgatttgcttcttaattcccagatcactctaattagaacactgcaaaaactgacaactaaagcaagtggccacctactagttctcacacactggactctctaacagtaatgaatttctgtgattatttccttgctactaataaaatactagctggaaaagtggtcaagtgaggagccaccagaattttatttcttcttcaagcatttaatagccaactatagggccctgggcatttactgaaaggcaatttcagttatgttagtaaattgctgtttaggacaacagatcaataaaataaattattaggtctataatttaggtatttacagagtaaggacaaaaaatactttttcactctgtgtattcaaagcagttgatccatgatttttggatacataatagctgtatgtatttatgagatacacgtgatattttgttacatgcatagagggtataatgatcaagtcagagtatttagggtgtctgtcatctggagtatacatcatttctatgtgttgggaacatttcaagttctctcttcttgctgttttgaaatatacatttttgttaactgtagtcaccctactgtgctactgaatattagcatttattccttctacctaaatgtatgtttgcactctttacccaacttctcttcgtctcgctcccccatgcacacacccttcccagcctctggtaaccattattctactctctacctccatgaggtcgatttttcagctcccacatatgagtgagaacatgcaatatttgtctttccatgcctggcatatttcttttaagataataactccagttccatccatgttgctgtaaatgacataatttcattcttttttattgccaaatattaggttggcacagcagtaattgcggtttttgcaatgataatagtattccattgtgtacatacacaacttttttgctgtttttctcaatgactctagagaaacatttattcgctaatacattttctttgtgttctctaacttaatgtcatcttttcatctcgcttgattttcatgcagctaaatcggaaatttgtcgttttctccctaaaaaaatacaataaagttctttcttataaattatattctctgattttcttgtcagcctgcttcaagaaaatccatgtgtgcaaaatacttgctatcagtttgccccataccaaatggctgtttaatccaaatatctgaccagcaaaccaagcaattccttctgaagaaagggtggttggacagccaaagccactgggtagtggaagagaagaccacccatcctgagctccccagtctagtgtgaggggaggacagctgatagctggagatgcagcatttccagatgtcactggtcccaaaccattatcagagtaacactggcctcatagaatgagttagggataattccctcttcttcagtctttggacggtattttcgaggagagctcttgtccgttctttgaaagtttgttagaattcaacattgaaaccattcagttttggactttgctctgttgggagactttttttactgattcaatctcactgctcattattggttcgttcaggctttttatttcttgctgattcaatcttgataggttgtgtccagaattttagacatgttctctaggtttttggtttgttagtgtatagtttttcataatggtctttaattatgtttttatttttgtagtgtcagttgtaatgtctcttttctatttctcatttttttatttgggtcttctttatttcttggcttgtctagctaacagtttattgatttcatcttttaaaaaaccaacttttcattttgttgatcctttgtatttttttaagtctctgtttcgtttagttctactctaatttttattatgtatttccttctattaattggggctttggattgttcttgtttctctagtttcttgaggtgcattagattgtttattgaaatctttctacttttttttgacataggtgtttatggctataaattttccccttagttttgcttccatagttttggtatactacgttttgacttgcatttgtttcaagatatttcttgatttcttccttaatttcttccttgaatcaatgatcattcaagagcatgttggttaattttcatgtatttctgcagtttttaaagtgtcccttgttactgatttctagttttattccattgtgatctgagaagatacttgatataattttgatttttaaaagtttcttcagacttgttctgtttcctaacatatggtctatcctgggaaatgttccatgtactgatgggaagaaggtgcattctgtagctgctgaatgaagtgttctctagatgtctgttaggtccatttggtcaagtgtgcagtttaaatccttttaatttttttgataattatctgtctagatgatttgtctcatgctgagtgtaaggtgttgaagttcccaactattatcgtattggagtctatctctccctttaaatctaataatatttactttctatatccaggtgttccagtgttaggtgcatatgtgtttagaatttttatatccacttgctgagttgatcctttttcatcatataatgatctttcttgcttctgtttactgtttttgacttaaagtctgtgttttctcatacaagtttagctattccgtttgtttgtgatttccatttacatggaatctcttttttcacctctgctttcagtctgtgtctttataggtgagataaatttcttgtgggtggaagagagttggctcattttttttttgtcttttcagccagtccatatcttttaagtggaaggtttaacctatttacattcaaagttattgttaatatataaaagcttattcctgtcatcttgttaattggtttctagttattttgtaatgtcttttgattctctttctctcctattgtttattatagaaaaccttctgtagtggtaacatttgaggttttttttttttttttccttatttgtgtgtttgctctaccagtgggttttatcctttcatgtggtttttatgatggtagatatcatcctatcacttccaggtataggactccctttagcatttcttataggaccaggctaatggtaatgaattccttccactttcacttgtctgggagtttatttctccttcatttatgaatgacaacttttctgggtatgtaatccttgggtggcattttttttttctttcagcactttcaatatatcatctcattcttcctggcttgaaaggtttctgctgagagattcactgttagtctgataggggttcccttataagtgactagatgcttttctcttgctggttttagaattctctctttgtctttgacttttgacagtttgactataatgtgctgtggagaaggcctttaggaattgtatttgtatgggaacttctaagcttcctgtatctggatgtctaaacctcttcctagactttgaaagttttcagctattattttgttaaataggttttctatcccttttgttttctcttcaccttctacagcacccagaattcaaacatttgatcacctgattgtgttccatatgccacaaggctttgttcattctttttaattttttaaaattatttttgtctggctgggttatttcaaaagaccgctcttaaagttcggaaattctttcttctctttcatctaatatattgttgaagctttcaaatgtattttttatttcatttaaggaattattcagtttcacaatttctgtttggtccttttctgtgatatctatctctttggtaaatttctcattcatattctgaattttttttctgatttctttgtattctcttgcatttcactgagtttccttaatatcaatattttgaattcttttttcaaggatttcataaacttacttttgattagaatatattgccagaaaattcttgtgtttctttgaaagtatccttgtttttccatgtttcttttgtccttacattgacatctatgtatctggtgtaaacatttcttcttccgggtttttgaatttgctttcctaaggaaggactctgttaaagatgaatctgtggtttaggttgggtaggacactttggctttgattctggatgcttgcagtagtgtaatcactgtgtgatttatttggctgtaaatagtatcagtggtgtcagtgatttcctcagtgactgcagtgtctgtgatttcctcagtgatttatgatacagtggaggctgtgatgaagattttctggggacagggacaacaggtgggcctgtcctcaaaccccactggtggccagtcacaggccaaacatgcctttccttgggccccagggcaacatatgctaatatacctgtgttagcaggctcaggcaggccattcttgggcctctaggtggcttgcccaggtgctggtagtggcaatggtgggccaggtgggtgggtaggttatcagacctctgggcagcagcatggaatgggtgatggcagtagcaatagtgagacaatcatctagctctgaagtgatttgcattgtttgttggcattggctacaatgggctgggaaggccagtctccagtcccacctgtggtatgtgtacgtgggtacccagtatggtgattgcattgttgtgggcattggctagaatgagctgggcaggcgtgaactcaggaccacagaaggagtaccctggtgctgatggtggtcaacttgggtaggtggtttccaggcccttggatgtcatgtctggacatagagtgggggagagagccaggactggtggacctgtcctcagacctcccagtggtatgagcaggtgccagttgtggtagacaggggtggagtgatccacatgtccccaaagaaatgtttgagagaaggcagcagctgcaaccctgctactggggaaggcaaggttgctttcagtggcagcagctgtatacatgtgtttagggaacacacattttcttcaagcttgaccctgggaacagcagtcacttgcagtgacagcagctgtgggcaggagagtttgttcatggggcacatgaaaatgcatggcagctttgttcctggggatattggggtcacagtcaatggcttgcacttgaatattggctgcaactagctgccagccatgacatgcattggctgcaggtgaggaatgtcaataggacaccagggatgtggtgatgcaggtaccgttggacctcccaggcaggatggtaggggctaggctttcaatatggtgacttgctgtagctgcctagggcttgggggcagagggtgtgactcagcttgagctctctctggagcaatgccttcacttggtctccttgcagcttcctatgttagtcttggggcccactaggtcctagggactctcctgtgtctaggattgcatgagttcatggtgggaacctggactgttgggggtcactcacttacccttttcctccactggggagccagcctctccaggttctcagccaatgctagccaagcaggcagcctcacttccccttccttttttgttttggttgtgtcctgtcacttatctgttgaattctaatgttctttcataaatgatctattcaaagtgtgatcatctattcactgtttttgttcttctctgtgtaagagacacgtagcagatgcctctagtcagccaccttgcaacccctctgccatgcagttaatacatgattttttctacttttggatggaattagataaggcccaagctaagaactccatacagcccattttgtaatatgatccagacacagagatgcactgttcagatcctcgttcaaaaaacgacccaccgcatagctgagagggatgtggtcagctgatgcctccagctgttagatccttcaggatctgtctcagttttcaaaccaaggttacgctcttctctcagtgatctccaggcaatggccgagcagaatgatggtacaagggccaggtcatcaacatcccctacaggacttctccatcaggttatctttactccagaactcccctttgagctggtaaagaattttagatctgcactgagatctgtcagcttcctatgcccaatcccgcatcttacttttttctttaattggttttacttccaataaaactcttgcaatcctaactccatctcagcatctgtttcccagacaacccaacttgcacaatgtccttacagtaatgcaaaaatgaatttcacagagctctttttgtaaagatgctgatacatgaagtctcaaatttcatggacgtgacataaggaaggcaacagcttgggaagaaaatatgagaaatagcacttagattgggtttattctagaagaaaggacacctcatctaactttctagtagtcctctataaacactgttcctctggactgggcgtttgatacataccgagcagccttgttttcaaggttagagtccctagaaaatagatgatgttcagagacaaacctgtctaggtactgagaactctttctacttgatgtctgattgccatctccaacagattatattttgggatgaattattcatctttagcacataagtaatctttcttattttcttattatctttacaaatcagtgtaatgcccagaaagcccagtgtacaatcaaaattttagttgcttatttttttcttttgctcctttatgtccaactagttactaaattatgtttatgtgtctttgaaatcttttgccttttgcttgtcataagatgcccaaaagatctgtcttttggccaaactccatggcagagataggctacagttgtacaccagtttgtacagtgtacaaaattgtacaccaactttgttttctttttctcctgtgcaagataaccagctggcatcctacaaaacacacatgaattttaaatagaatttgtgaggaggtattgtttctgcatgttggagttcctgtaaattacatttacaactctttattggtatcataatgttgatggagaaatagatctcctaggaatatgtgcactgaccattcaactatccccatagctaacattttggatgcattttaagcttcttagcttagcacataaatcccatcataatttatcctctgtttcccaccatcaccactcctgaaacacagcctcacagactatttactctagctataaccagttataatgcttcatgcttcatatatgctatttatcttttcaagaatcctttcttttttgccttctgcttaaagacaacttctacaagccttcaaacctcagcttaagcattacttcctatgtaaactcttttgtgatctcctaatttgactctttttccctaatgcatttatttccattggatctcttttatacttttatcataacattgactataccgttccctaaatgttgctcttttagaactataatcctatattatttgacttcatatataaatgtgctctaaaaatgttgaatgaatatggtgagttttccactttgatatcttcatgctgtcttttaccccagggcctcaaattagccatcagaacagatggcttataagaactggtatgctaaaaagtaggtttaactgtggttgtggacatgcttctttctcaggggttccatttctgaagtggaaattaatttgatgcttctctagagtgatgttcagattaatgttatgccatttgtaaaggcctctaggactctcagatgaagggcatttgatattagcctcattgttactcgaagctgttgtagggttcatctatttgctactcagcaagacatttgacattctcgtaatacagcacatcccaggattaattaagagatttccggaagtctcaggaatacacctactttgacatcaatgtgctgtgaatgttgatcttggtagccttactttgaatagctatagggtatttaaatagtaacctaacttacaattaagactgcttagtccctgtaaggattctgagtggaatttagcaatggataatgaatatattctccggagtcttatactgaatttgaaaagaaacccaaattcctgagctttagtcacttaactacaacatctttctacataaagaccataagctaagaccatagaagagagagctcatgcatacatgagtacagatggttaccaaagtaaggatctaaaattggactctgctgtactcacatcgaagctcccaatgtacgaagggatgaccttccttcaatggctttatgcaagggtcaaaatgtatttgaactctggagcagaaaagcactgctctataggatttccaagtgttcattatttaggaggtcaggaacgatgggagcatgtggcaatccagacagctgcagtccccacagacctaaaagaaaacagctgccagagcagccatttctatacaaaatgtctcatgaccagaagctatggaaataaacggctagaggcagctgtgcttccctcttgctaaacactcaaagattccatttttaacacaggatgtctattattaagacaatcagctaagatgtcaattcaaaagccacaaagttctgcaacataaatactgtactgacttctctcttctgttgtgtgggaccatggcttctttccctgtatgctggggacactacttcagaataatcaagtgaaaatactgcttttttatggtaactctccattcaagaacttattataatagtgttataaaaagactgtaatcttatcataggctgtatttgaaaattaagatcctccacaatctggctctatcctctttctcaaatcaatttctcattactctcaatacaaatgctatccttcaggtaggtaagactcttcattcttgctccacgtttcttactcacgttccttcaggcaaaaatgccctgtcagacacatgaaaaaaatgctcatcatcgctggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactggttcaaccattgtggaagacagtgtggcaattcctcaaggaggtagaactagaaataccatttgacccagccatcccatgactggacatataccgaaaggattataaatcatactgctgtaaagacacatgcacatgtatgtttattgcggcactattcacaatagcaaagacttggaaccaatccaaatgcccatcaatgatagactggattaagcaaacgtggcacatatacaccgtggaataccacgcagccataaaaaggatgagttcatgtcctttgtagaacatggatgaagctggaaaccatcattctgagcaaactatcgcaaggacaaaaaaccaaacaccgcatgttctcactcataggtgggaattgaacaataagaacacttggacacaggaaggggaacatcacacaccggggcctgtcatggggtggtgggaggagggagggatagcattaggagatatacctaatgtaaatgaccagttaacgggtgcagcacaccaacatggcacatgtatacatatgtaaccaacctgcacgttgtgcacatgtaccctaaaacttaaagtataataataaaaaaatttttaaaaatcccctgtcagtcctctctgcccacccttttgacatttgatggtaaagcccaatctttcctctgcccacattagtcagtgatttctttaaatttcatttataacgatccctaaacctcataattccgcaaccaattacatgctagtacacgtgattctctaatctgtgtattttaatctcatctcctaagaacacggtggcaagatctgtgttatttactttgaggctgcatcccatttttttcttttgtgtttttttaattgaagtgaaatttgcatgtaataaaattcacccttttcagtgtacatttctatgagttctaagaaatgcatgcagttgtataatcaccactacaattaagggatagaacagttcgaacaccctaaatattttccttgtgactttgtagtcaaacctctcccacctgcagccactgataacctgatccatttcctgcctctatagttttccatctatgaaaccatgcagtatataggcctgtgtgtctagatccttttacttagcataatgcatttgtgatcattcatgttttatgtatcagtagtacattcctttgtattttgggtaataattcattgtatggatacacctagcatgtttatacatttaccggttggagaacgtttgggtaatttccaatgtgggaccataaagccactataaacattctcacacagatttttgtttgaacatacgttttcatttcacttggaaaaatgcctgggagtgggattgctggattgtatggtaagtgaatgtttaaattgatgagaaactgctaaactgttttctatggtggtgtagcgttttgtttttagaccagcaatgaatgacagatccagttgctcagcatcttagtcattctaataggtgtatagtggtatcacataatggttttaattagcatttccctaatgactaatgatattgagcatcttttaagtgctcctttatgttctatattttttggttatttcatagtactagcaaagtactaacaatgtattagatgcttaacgaatatttgcagattgttaaattgcagatcattaatactactctcttttgcatgccatttgcatcccattactagctgttaccatttattgagtacctactgtatgccaagcgctgtagtaagtgctttatatatggcatcttattaatacacataagaaccctatgaatgtgctgggtggtattgttcccatttgataaggaaaagggacaaacagtgctgacttgtgactctccaaatccttctctttccccaggaattttgggtttgcttgttcaggttctggaaggtttttatactactgctaaggatgagtgaagaggtaaatttaaataatccaaaacaggctgaaatgatccacatgataaagagataatttagaggttagtggggccatgaggaagaaagggaaaagtacttgggagaggcaagggaagtatagttgtggaggtagaagagagagaaagaggttctttgtttgtgtgtttgtttttgtttcagtttttgttcaaaaaaaaaagacaagagggagcaagaattgtgaagaagactgaggggttagagggatgaagagagtgtttagtatgctaattatgaaatattctctttttggagtttttttgagtgaataagattaaaacaaggtttttagggaaaaggaattggatttttttatattgatactagtataagccatagagcttattaatatttcaacagttatacacacccttacttgtgcacgtgtgtgtgtactcatgtgtatgtatatgtagttttatgcagtttattaaatgtgtagatatgtgtaaccactaatcaagatatttaactgtaccattaccagaagacttcattcttcattgtgctacttatttacagcggaatctacaccctcatcccttacccctggaaaccattaattgttttctccatatctataatgatgttatttcacaaatgctatatttataaaagtatgaagtatgtattcttttaagatttttttcacccagcaaatttttttgaggttcacgcaagatgttgtgtgtatcaagttcttcctttttcttcctgagtagtattccctgatatgcatataccacagtttgattaattgttcacacattaaagaagatttgagtagtttatgttttggactattaataaaactgctataaaccttggtttatcaatttctgcatgaaattaagtcttcctttatctaggacaaatgtccacatgtataattcctggatcacatagtaagtccatttttatttttattttaaaagaaactatcaaactattttacagagtgactgtactattttagattcccatcaggaatgtatgagtgattccgcttatccacatccttgccagcatttgatgttatcactatttttatcctagtcattctgataggtgtgtagtaatattttgttgtggtttccattttaatttctctgatgactaatgatgccaagagagttgtcatgggctaatctgccatctgtatagtctctttgtatacacgtcttttgtccattttctaatttcatgtcttttgcccattttctaattttatggggtttttttagtattgaaattgagaattatttatatgttctagatactagtactgtgtgagatagatgatttgcaaatattttctcccagtctgcaatttgtcttttcacccttaacaggctcttttacagaatactttttttttattttgatgaggtccaatttatcaacttttcttttaatcatctatgatttttggtgttaagtctaagaactctttccttgtcctgtatcttgaagattttctcctatttctttttctagacattttatagttttgtaagctgcgcacttacatctatggtccatttttagttgatttttgtataaggtgcaaggtttagatcaaggttcatttttatttagctagttagctatttgcctataaatcattgcatcgtcatttattgaagacttttcttcctccatcagattgcttttgctctatttaagaaaactaattgggtataattaggtttttatttctgtgagatgcaacttgtaccaacactggtcacaagagagccagttcttactctggttaaatatggatcaggaaactgaaactcagtttaagtaacataatatagcatgtatccacctactacttggctgtcctttttacaaagtttgtaaatgccatgttgaagttaccttgttttctggggtaatacccaaggtttgttgtcttatgtcacagatatcgaggatgcagacacacagagtgaggttaacagtgaacgtttaataagcgaaagaaagataataggtctctgctacagagaacggttctggaaaaatgggttgccagtccacagtgaaatgccaggggctttataggtgagctggtggtgaggcagagtctgatctacatagggcacaaaaaaactggttaggactaagtgtgccattggcatagggcgcaaatttctggcagctcccaccctaagcttttattatgcaggcgagttctctgcctgagctgagccatgttgccaatttctttctttctgtacatgtgctaaccaaaaagggaagatggagcttccatggtggacatgcctggcccccaggtagcccttttctattgacgcagctaccggcatcccccgtgcaagcttccagcttccttatctatgtttgcagctcgatttttcaggctgctgtttgtcaggaaaagaataatttcttgggctgctttttgttagaagggaagttctgccgaggactctgttgccctcactatctgccgaaataatttctttctacattctgtatcagtattgctaggatcatgagttggacagtgtgttacacaattttttagatatcaaagtagtatttatatgctttattaccacagcaaaactaacccggtgctcagcttgaggtgaactttacattgatacctttcccttctctaataaagcaagtagattgggagctacatgcttggcaaatacataacaatcttcttggtatgtttccaaaatattttgacaacaatatcagtggaattcttggagcttatcaccaaaatctgggtgaagtaggcctttctatttctaaagaaaaaaaaaggagagtcaatcacctttcctttaggtcctatggctggtatttaaaaggctgagtaactatgatttaaatgaaatgtcgtatttttaaaacactgaaagctgcagtgactacaggcctggggaggttcactctgatttgctgcccatcagatctgcagaaggcacacactaattcccgaggcgcagcattgtaagacttaacacggccaacactaataattaggcctggttgaaaagtggcagagaaatgctcaatttaccagcagtatcctcacctaatttcatatatattttctaatttgactttgagttaggcagtatcccatttcatggaaatgggaaccagattcagaggagggaaatagcagagtaaaatggcagatctgtatctgactccatagctaatgctccaccttggggttttatttcttccaatttagaatttacggtgagttatagaacttacactgcaacttaagttaatatcaaatcacagaatatttatcctggaagtaactccagggtctcactggagagtcttaatgttaaaatatactttcatactattgatgaaaaaaattttgaggagaatttaaaaaagcaaacagccagacatgggcagggcggggcacatgcttatagttttagctgctcaagaggcggaggtgggaggggtgcttgagtccaggagttcatagtgagttatgatggtgccactgcactccagcctgggcaacagagtgaaaacccgtctcaaatacataaatacatagcaatgtaaaggtagcgcaaatagcctaatttcctctgttttttttttctgaattcactcatattactataatagtaccaattatatactttattatatctaattgtactcatgtcccttgtaactaaataactccttgaaatcaaggataaattcatagtcatctttgtaatcatattgcttgatatagtatctgatgtatgaatgttaacgtcagcatgattaattgtaattaaatgtgcctagccaagttaatttatttattttactttgaccgtggaagcacagttgtattagccatggaatgctgcctcaaatacctttcatatataggtataggtagggtaaaaagctacacagaacattactaaactccagctttcatagtcatttgtatgagcacgtactacacaggcaattaatgtaactgtagctatttttatacatggaaacactcttaagggaaatgatcagtttcttaattaacttgtgatgaaatgcatgatgttgttggaaaatatgtattctgcctggttttaactgactctataatattattaatttattaatatttccagtttttgcataagaatcactagtactttttaaagtgaacctcttacaaaacaaaatatatttcagtctttagagagttaagtcattagacatagcaagttcaaaaagcaggatttgagatcatttttggtaagacctgttttgctgactcttcttgttatgcaaatggcattttctcagttttgtatcctgggtaccatgtaaatggatagagaatgatgagggttgctcactgttggttcctataaaaagtaattactaaaaaacataccacatagccatttacaaatatgactgctaagtttatattgcagagcagcacttcctgagcccaatgtaataatggcttaatctaattacatacacatatgcttgttaacacatgtaagtttccagtacacaataatagtgctctatatctcaagagctttagtattactattgcactgagacataaacactttttaataactgtcctttaaggattttcaaagaaaaaacaatctatgaaaaactctgttaacagggagttcttaggaagaaaataaggaataatgggcataaagagatgctaatattttgtgattgtcttgcagcaaaatgttattaaaagggatagttaaagaggttattatttcacctttgcaaatactaatgggtgctcttgcctccttcattgaacttttagctctccaaaggaattgcagtggtcagtttgttgcagaagctgggtacctaagcactgccaaatgccccacccacagatctctactccaactgcaaacaagcccaggaaggaatgttttttctctctctctcacattcgatacaactgctcaatctacttctctctggtagacatagctccaaaaaccaatgactgattgaacaaattaaagggaatcctgccactagaataaaaattattctaatctggctggtatttttattaattatattcttacataacaatctggcagaatttgagtgaatctgccagcttctgtacacagacctcattgtctctaaatgattcacctaactgccagtggtcataaatacaataataacaacagcaaccaccggagcaaattaaaatgttttacactggtaaacagcgtaactgtttggctgaaactgtcacttaaaatcttaaattatctcactaggtaggggtatgaaatttcaacacaactagggaactaagtctaagctatttaatatttgaataatattaaaaacaagagtaaaatacttaaccatgctgtaatttcccagcattcctcttgtagccacccgcactgtgacttttgcctttctctcttttttcacttccattacctcctctgtaattgaagcatccacctctttatatttccttcaacagacaaggttttattttccatgtcctttaccactactgtgattgaagatttcctactttctctattcccatcattcacatcaaagttaatatgttcccgccttgtaacacacccaccttgtacattttaattaagacaggcactcctgtattctgtgtgttcatcacctgatcttcactcatattcttctctttctgtttttttcttatactcaatgactattttcactcttccccaagattcacgttttataaattccaattttcccaaagcgaagtgacacacatgttccttttgtctaaactgacctgtatgctaatgactcttaatttcattctaagaaaagaagaaaagagaggaaaaagagcatttatggtatacaaactgtataagcatgcccactagacatactgttatgtctgtgggagataagctgttctaaaaataattcctcaaaagcaaatagcagactctgaaggttaatgtaatatgtacagcattcccatttcctttctttctgttgtgttgaggatcaccaaacaagctaatagccctcaagtgtgggatcacgttaaacaaaaacaggacattttgattcatggatgtgccaagttacaaagtttatcctttcaaaagtttaatgctgagtgatatggttaggctttgtgtccccacacaaatctcatcttgaattgtaaccccgtaatccccacgtgtgaaggaagagaccaggtggaggtaattgaatcatggggacagtttcccccatgctgttctcacgatagtaagttctcaggagatccgatggttttataaggggccctccccacttcactaggcacttctccttcctgccgccttgcgaagaaagtacctcgcttccctttcaccttctgccatgatgaggcctccccagccatgctgaactgtgagttagttaaacctctttcctttataaattatcagtgtcaggcagttatttatagcagtatgaaaaaaagactaataccctgggtatcaaggtctttatggttttcatcaggataccaagttctagcccacagcctgtgagttatagggtggcttggtggcttggtcatgatgacaaaccccatcaattcccaaatatgttgaattaattaattaacacattaattcaacaagtatttatgcagtgccttgtctatgctcagcattctgtgagatactgtctggtaaacaaaatacacctaagacatagtgtcttacctgaaatagaatcctagggaattaggtgggcaggcatacctaatctgtaattgagttggtactaaaatcagtgctggtttctatgttgttgttgttgttgttattgtttggggtttgggcttgggttttgggttttcctgtatatttccacttgagtagtaatgttacagtatgtttgtttatttgtcttgtttgtttttggttttggacttggttgacaaaatcagaatatatatgttatgggtttgcagttttcaatcactttttaaccctgttaactttagtctcaagtaaacaaaaaattactgagacttctataaatctaagcaatgtcaggttcagaaaaagggtggcatttgtggtgtatgccttttcactcccctttgctctagtatctcaggctttcctgtgtcctccaggctgacatttagtcccatggaaacaagacttataaggagcattactctttttcattccattaaaatttaccttaacgttgtgccatttcttccaggagttccctttacatatttctgtcatctaaaaaataaatcagtttctctttaaattaaaccttcctggctcctttgccccattgaatcctggaggaaaacaggaaattaagtatgaaattcaggtattaattaaaataaatgctcatagtgccctattaaattggctgcattttgacaggaacactggttcaagagttacctactctcaactgctgtaatctatatacctccatcatttccaagcatcagtcaagttctgaaacacggacttctaacttcataggcaattgtttaccagcgtttcagtttattactaaacactggaaattataccagacatcttagtcctggatggggcatgcccttctgatcagcaagtctgttcagttataacccaaaacgccatacagtttaaggagaatgaaaacagaggtaccaaaccttttgaggaattgtcttttccacttttagctgtttctatctaaagaactggggctagccccaaaccatcagcgtgccctttcctcatggacagtgtgggagaaatacagaccaatcccttctctttgtggatttcatgcagtcccactcttctaattttatttgtcagtaacatgttccagtttctgagatcacaattaatcttacattaattacattttaaattaaccacaatatgctctttcagcagcacttaaaatgtcatcagcaagacattgcataaatcattgttgagcgtggtttacttgtgaggagatttatgtagatgataattccttaaaaggcacatggattttttaaaactcttatcaaagtatgatatttctggggttcgaccacagttacaggaaggtcatagtgtatccggcagtttgcacagcccttcacctaattttgccaacaagcatatgaagggaaatatattttcttctgtgattatccattttgtgttttgtcagtttcaatgacttctcttccagatttatgaagtttatatggcactgttatgagagacctattccaactctgccttttagtacctccagacccctaatgacacaattatgagctttctcaagtaatgttattgcttaaacctttaaagtctcccaaagctcggagcactatttgcaaatatgtagtaaattaaactgcaacacctgctactgtgtagttgtgtcacaggtcatttcatctctctgggtatcagtttcctcaaatgtcaaaataaagggaagctagaatcactgtaagatcttctgcaagtctaaaattctggtattctctgaacaatgctatagatagttgactttcactttcctcatatcacactgactgattgatgttgattcttatctcaaaaagtaagatttctagctctagagagaccttcaagattgtcagctctaacacctccattttgcagataaaggaaacttagggcttgagaaatgaagtgacttctcaaactttccacagtcagcaagtggctggcactaaatgccaactctcctgctactgataaagttctctctcctctactccatgaaaaaaaaaattcttgcatttttatttaagttgaagatatttcaaagtaaacctgatcaatgaaattcaactgtgaacacgtatgtcagaatattacagtcaggaaacaggaaagggggatgaaaaatggcatgtgtagtaggacccagacagccaaattaatattgattcaaagaaccagaactgcaatgaaataaggacagaactaaagaaattcagaggtttggggaaaagaaaaaatttaataaaaatggaaataagactcagacaagcacagctatgcttttgtcattgacattcagtactattaagttcatcttcatcgggacattggtaaggaaaggcgtgtgatctctttgcagactgatagactttttggccctgtaatgatagactttgtctttttttttttagaactctagttgcaaaactctgcttatacgtgaaaaaaagatcagtctgcatctgtccctgttgctaatagtaaccatctttcaaatattgccagcttttcatatcacaagcattttggtccaactcacttcacctcattcagtcttcgctactcaggacttccttttaattgacacacaataattatacatatttatggggtacaatgtgatgtttcagtacacatatgcattgcctaacgatcaagtcagggtatttagcaaacccgtgacctcaaatatttattatttctttgtggtaaacacttttagaatcctctcttttaggaattctttgtatagtttcaaggcttctgccacctccacagaatgctttttggttctctctgtgatctgcacagtgtattttttctcatttcatctactgcttgtcctacactttcatttcttcatagcactcctgatgtatttcaaaatctttaaaagcattactggtaatcatcataataataataatgaggctataacattttccataccacagtcttagaaatcatctagtttattacgttcaaaaaatttcccaaaagaaggcctaccaaacatgtaataaacctaaaaatgtatcaggcactagttcagaggctgcatacaccaatctgatgctcataaactcattctagctatttgtacaatacaggctttcttctccaaggtttccatagagtcctagaggaattattagaatcctgagccggaattaaatgaaatgagtgttaaactgtgatctggtaaattgaggtagatggtgcaaacagctgattgttaaaggaaagtatcctcaagcctcacagttgcagggtctgttttataatctcatatcctagttttgcctatttggccattgaaaaccaatccaaacagcctctttaagtgacagctagattcaattcctgttgaggtgttgttgtttaaaccctctctccagagagcttcagtgggattgaaaaatacttgttccctggaagctacagtaggaatgctctatgatttgtgcataatacatatgataatctgagctttaaattaatccctaacccttctggataatacgctgcaggtaatttctccttcctatattacactgcggaagctagaattcagaagtatagtcttgctcaccttttaaggataatagagcttcaaaacagtattgcaggaagcaaagtggaataaacagaaaactgtcaaactagatgccactactgtgagttgttgaaaaggttaaatgtcagaagcaaatataattggatgactggaatgaatgactaagtgctttttacactaagttgcttgtttcacaagcaaccctagacccttagaaacagggttgatgaagtcaaagggacggccattctgtcttgtctttccccttctcagatcagcagaaaagcagcagaaaaacatggtgttggattgtagtccctacagatttggtacttccaagactctcccactccagcaaaaagaaaggacactcataacctttcctttttttctactccatggtaaaaatctagagatgggtatagtgcaaaatattcagattttggagaattattatccattttgtacttaaaaaaaagaaatcttttgagaatttaaacccattgtttaataggatctcaaataaagcaattgcactaaaattcaagccaaagaagccattaagaactgatcatttatttggaggaattaatgttattttcctttaaggaaacaaagataagaagcatagatgttttaaatgcagttcttaaaacaatcttttcttcttaatgcttcagaaattgtttatgatcaaaagatgcttctgcgtttttatattaaagccctgccttgggcagggagcaaggagaatatatcattattagtgggaagctcgcaagaaagatgagtgtcccccactctctctcctcctctctggagtccaactgcagctgtaactttggctctgaaatttgaacaagggaggaagaaggctggatctggtgtcaactgtgaacgtgatttcccccaaggcaagagccaccccaaacagggcatgtactttaaattgcttttcgggtaaaggtccgaggtttccattgaaccagtagcctaaagttgtgaacccaacacgagacttcctgtattcccactctgcttctaccacaaaccagttttaggagcttgaaaagatcacagagctgctataggcctcttttctcccctctgtcaagtgaggaactaggaggaggtggcttttagtctttttcagtttctgactgtgtgaaagctatattcttcctgactggtgaaagctttgtatattatccctcacaagggatgttttctttttaacaagaaaacaacaggagataggtaatatcagcaaatactgcatgatttctcgtataaaaaggcatctaaaataatcaacagtatggcgatagagaatagaatggtggaagggcatggaatcagggggataacgagagctgttactcaataaatataaatttattcaagatgaataagttccagagatctcctgtacaacgtgatacctatagtgaacagtaaagtattatatacttaaaaatttattgagagagatcttgtgttaagtatccttgtcacacacacacacaaagaggacacaagaagacttttggcggtgtggatacgtttattacccaggttgtggggatgataatgtaactgaacccaggactggccacttgctacttaaaagccagacatgacagacgagggttggtaggaggaaaatgaggtttatccatagagccagtacaccgcaaagagggtggactatagcctcaaagaccatcttaagtcagcacaggtgttaggctgtctttatgttaagggcagggggaagagaaggggaatctagatcaagagctgaccaataactgcagacatctgggcagcagcaagggtccgagaaggttgagaacgtctttgtcctgggtcaggtcacaatgctcctataaatccttaacaaaacagagttgtttacatacttccccctttaatcccagatttagttgtaaatctgatttacaactaaatacatgatttaatgtaacatcacatacatttctgttacattaggattagagacaagttctatttagaaataacttcaacagtttttatattttattttcacattgaaaatcggtcagacttgcttcagcctcaaagagcatgtttatattataattaaatgagcactggtggtgagctgtagtttctgtttctaaatgggaaatgggttaaaccaaaatgaagttaattatattagtttttttgctgtttcactgttacagtaatgctagtgtgtagacatacatatgcgtatatgtatatgtgtgtatatatatatatatgtccaacctcaacaaaattgtatacattaattatgtgcagtttttagtataccaattagacctcaataaagctggaaaaatgacaaaagaagacagatagcatcctgagtgcctccccaacctacctgaaccccagtagattggtgtgtaggtaggaactggacctttcatctctgtcttcccaatgtccagtacactgggcacttagtaggtattacataaatgtgtgttactggtcggtttaaatcaacaacctgatacctttctgagagtagaatatgagacctagtttaggtaccaggtaaagagattctaacctgctttctctacgtaagactaacctcaccctggccatgttaattccaatccttaatcttttaatctaatgagttaactatcagttgtataatttttatctgattattccaattcatcacatttaattatcttactgtttctgccttccattagtgaggaggagaaaacatttgctaataattttattatgtagtagggactgtagtaagtactttatatatcccatcatattttatttaacagcattctcaaaaacactgaggtagaaattatgacacttattttacaggtgaggaagcagctcgtagcattttagtaacatgtccagattctcatcactaagcagcatcatagctaggactggaaacaagcctgtttccaaagcctgctttttttttttttttcctgcgctcactgcactggagttttcttcccctaccaaataaatcaacattatttctgagattgcataatgggagtatgagggacttggataggaagcagagaactgtctgaaatgacattttctaatattggtggtagattgcattgatccagtgagatgaacatctccatctcactagccacccctatggtcatcaatgtgcatcttgttatgtattttggtgcacctagtggtacaaatgagaccacaaatcttattcttgtgtaaagcatcagattgttttgggctcgccatccatgtcttttgcctcattagagccatattctactcaatccagtgagaaaattgccatagacgacttttcagataacaatgatgaatactactttatatatgtatacacacacaatgtgtgtgtgtgtgtgtgtgtgtgatcaattctttcagcttagtaaaacaaaagtgttagcagaatttttacattcaagttttctgacagtcataatggtaaataaataactctaattctgtttctcaggtgaagcgaagttcggaagttgtcaggctactgaccactctgatggaactagcaaggaaatgtgtgtcatatattattttggaaaaagaggatttttaaactgaattcttaaagttgtgaagagaaaaactgaaacctattttctcctcttggttaccagtgtccatttagcgcccagaaatatcaaatggggatcagagtagccctaaaatgatgccataacacaccttgcaagtttctttcattgtgaaatttgtgagtctgataatacatcttttttcatgtttctagttagcccctttattgcatgattaataaaagcaaagggatgaaggactggggaactcagtgggcaatgtatgcgataataatatctaatcaatttccttctgcaagtttgattacattaagacttctggagaagaaaattgattggactcattcacttgggaacctttcaggaaacaaagtgatttcttttagttttctattgcaactgatattatgggcctagagccaaggaaaaatgaattgtcctatcctaatcaattacttaaatctggtttttataccaagtgttcataaaattggcaaagcattgaatgggtggaaaaatgctaaacaggaaatagaaaaagaacaaatcaaatttaagtaaacaaggatgaaaggaaaattatatgtataatatatattatgtataatgtatataatatataaatatatatttatatattttttgagacagggtcttgccctattgctaggactacagatacacactaccatatctggcttattttgttcattttttgtagagatgaggtctcactatgttgtacaggctgatcttgaactccagagctcaagtgatcctcctgcctcagcctcccaaagtgctgggatgacagttgtaagccactgcacccgggaggaagaatgcgtattaaaggaagtaatttagccttatctcacctcaggtgtccagacatttattgagcacctactatgtgtccggcctttaactagatgttagaagtctaaaggtgaataaatcatcatatctctaactttaagggcctcccgctctaataagaaaacatgcacacacacgcacacacacacgcacacacacacacacacacagagttgtgaaactactagatggatcaatggcaaagatgaggatagggaacaattatagcacaagaaaaggctcctaattcatagaattaggtaaaaaggtatttgctttgaggcaaaaaaaatacatcagagtgtacaaaaaagaaaaagaaaaactgtgtggaccacaggattttgtaattgctgagcatgctgtgtgagacatggaagcttacaacatgaggagcagtgagggtaatagagaagatggattgtagaaaatcataggtgctgctctttgtgaagcaggttgtacttcaggcagtagaaaaccactgaatgtttttaaatggtggacaatatggtcagatttaggtgttgaagggatgattctggcaccattatagaacatgacttttactaggaaaagatgagagaaaaaagaccagtgaggatatagagattttccttgtatgctgcaaatggaattcctctttcaattttattttgaaggatctccactggatttaagtagtcaatgaattaaaaaataagggagtgaataagaaaggaggaattatagctatagccaacaattaatatctatggctatgaagatggaagttgacttcattgagcaaacaggaacacacttttagtatttaggctaatgagttagcacatctgatcatttatcttcaatctgtccacagaagatcttttgaggtaaaggatttccaaagaagtgggcttatgtcaaatgttccaagatcttgaacaattacggtcctttcagaagggcagataaaatccaatcacaggcataattgttttattgggttttgctttattgagcttcgcagatactgcacttttcacaaattgaaggtttgtgacaaccctgttttaagccaaccctattggcgccattttcttgcagcatttgctcacttcatacctcagtgtcacattttgataattctcccaacaattcaaaatttctcattattattatatctgttatggtgatttgtgatcagtgacctttgataatactattataattgttttggggaaccatgaactctgcccgtacaagacaatgaatttaatcaataaatgttctgtgtgttctaactgctccaccgaccagccattaccccatctctccctctcctcaagaccccctattcccaaagacacaatactgaacttaggccagttaatgacagtacagcggcctctaagtgttcaagtgaaaaaaagagtcacacatctgtcactttaaatcaaaagctagaaatcattaagcttagtgaagaaggcatgtcaaaagcaaagataggcccaaaactatatctcttataccaaacagccaaggtgtgaatgcaaagaaaaagttcttaaggacattgaaagtgctactccagtgaaaacatgaacgatagaaaagtgaaacagctttattgctgatatggagaaagttttgatggtctgcatagaaccaaccacaacattcccttaagccacagcctattccagagcaaggccctaactctcttcaactctgtgaaggctcagagaagtgagaaagctgcagaagaaaaatttgaagctagcagagttggttcatgagatttaaggaaagaagccttctctataacgtgaaagtgcaaggtgaaacagcaaatgctgatgtagaagctgcaacaagttatctagaaggtctagctaacgtaattgatgaaggcagctatactaaacaacagagtttcaatctagatgaaacatctttctattggaagaagatgccatctaggacttctatagctagaaagaaaaagtggatgtctggcttcaggacttcaaaggacagaccttgttaggttacttgaagttgaagccaatattcacttactgttctgaaaatcctgagactcttaagagttctactatctctactctgcctgtcccctagaaatggaataacaaagcccggaagacagcacatctgtttatgcatggcttactaaatattttaagcccactattgagacatacatagaaaaaaaaaagatttctttcaaactgttagtgttcattgaccttgcacctcatcacccaagagctctgatggagatatacaagaagattaatgttgttttcatgcatgctaacacaacgtctattctgaagcctgtgaatcaaggagtaatcctgactttcaaatcttattatttaagaaatacaattcatagggctagagctgccaaacagagtgatttctctagtaggtctgggcaaaataaattttgaaactactggaaaggacccaccattttagatgtcattaagagcatttgtgattaatgagagggagtcaaaaggttaacattaacaggagtttagaagaagttgattccaacccttatggatgacttcgaggggttcaagactccagtggtggaagtaactgcagatgtggtagaaataacaggagaagtagaattaaattttgagcctgaaggtgtgactgaattgctgtaatttcatgataaaactttaatggatgagatgttgcttcttccagatgagcaaagaaattggtttctttttttttattattatactttaagttctagtgtacatgtgcacagtgagcaggtttgttacatatgtatacatgtgccatgttggtgtgctgcacccgttaactggtcatttacattaggtatatctcctaatgctatccctcccccccccaccacccccatgacaggccccagtgtgtgatgttccccttcctgtgtccaagtgttctcattgttcaattcccacctataaatgagaatatgtggtgtttggttttctgtcattgcgatagtttgctcagaatgatggtttgcagcttcatccatgtccctacaaaggacatgaactcatcctttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcttctccagcacctgctgtttcctgactttttaatgaccaccattctaactggtgtgagatggtatctcattgtggttttgatttgcatttctctgatggccagtgatgatgagcattttttcatcatcttggctgcataaatgtcttcttttgagaagtgtctgttcatatccttcgcccacttgttgatggggttgtttgttgttttcttgtaaatttgtttgagttctttgtagattctggatattaaccctttgtcagatgagtggattgcaaaaattttctcccattgtgtaggttgccagttcactctgatggtagtttcttttttgtgcagaagctctttagtttaattagatcccatttgtcaattttggctttgttgccattgcttttggtgttttagacatgaagtccttgcccatgcctatgtcctgaatggtattgcctaggttttcttctaaggcttttatggttttaggtctaacatttaagtctttaatccatcttgaattcatttttgtataaggtgtaaggaagggatccagtttcagctttctacatatggctagtcagttttgttaaatagggaatcctttccccatttcttgtttttgtcaggtttgtcaaagatcagatagttgtagatgtgtggtattatttctgaggactctgttttgttcccttggtctatatctctgttttggtaccagtaccatgctgttttggttactgtagccttgtagtatagtttgaagtcaggtagcatgatgcctccagctttgttcttttggcttaggattgacttgccaatgtgggctctttttggttccatatgaactttaaagtagttttttccaattctgtgaagaaagtcattggttgcttgatggggatggcattgaatctataaattaccttgggcaatatggccattttcatgatattgattcttcctacccatgagcatggaatgttcttccatttgtttgtatcctcttttatttcattgaacaatggtttgtagttctccttgaagaggtccttcacatcctttgtaagttggattcctaggtattttattctctttgaagcaattgtgaatgggaatttacttgtgatttggctctctgtctgttattggtgtataagaatgcttgtgatttttgcacattgattttgtatcctgagactttgctgaaattgcttatcagcttaaggagattttgggctgagacgatggggttttctagatatacaatcatttcatctgcaaacaaggacaatttgacttcctcttttcctaattgaatgccctttatttctttctcctgcctgactgccctggccagaacttccaacactatgttcaatagtagtggtgagagagggcatcctggtcttgtgcctgttttcgaagggaatgcttccagtttttgcccattcagtatgatattggctgtgggtttgtcataaatagcctttattattttgagatacatcccatcaatacctaatttattgagagtttttagcatgaagggctattgaattttgtcaaaggccttttctgcatctattgagataatcatgtggtttttgtcgttggttctgtttatatgctggattacatttattgatttgcatatgttgaaccagccttgcatcccagggatgaagcccacttgatcatggtggataagctttttgatgtgctgctggagtcaatttgccagtattttattggggatttttgcatcaatgttcatcagggatattggtctaaaattctctttttttgttgtgtctctgccaggcttcggtatcaggatgatgctggcctcataaaatgagttagggaggattccctctttttctattgattggaatagtttcagaaggaatggtaccaactcctccttgtacctctggtagaatttggctgtgaatctgtctggtcctgcacattttttggttggtaagctattaattattgcctcactttcagaacctgttattggtctattcagagattcaacttcttcctggtttagtcttggaagggtgtatgtgtccaggaatttatccatgtcttctggattttctagtttgtttgcatagaggtgtttatagtattctctgatggtagtttgtatttctgtgggatcagtggtgatatcccctttatcattttttattgtgtctatttgattcttctctcttttcttctttattagtcttgctagcggtctatcaatattgttgatcttttcaaaaaaccagctcctggattcattgatttttttttttgaagggttttttgtgtctttgtctcttccagttctgctctgatcttagttattttttgccttctgctagcttttgaatgtgtttgctcttgcttctctagttcttttaattgtgatgttagggtgtcaattttagatctttcctgctttctcttgtgggcatttagtgctataaatttccctctacacactgatttaaatgtgtcccagagattctgatatgttgtgtcttcattctcattggtttcaaagaacatctttatttctgtcttcattttattatgtacttagtagtcattcaggagcaggtcgttcagtttccatgtagttgagtggttttgagtgagtttcttaatcctgagttctagtttgattgcactgtggtctgagagacagtttattataatttctgttcttttacatttgctgaggggtgctttacttccaactatgtggtcaattttggagtaagtgcagtgtggtgctgagaagaatgtatattctgttgatttggggtggagagttctgtagatgtctattaggtccacttggtgcagagccgagttcaattcctggatatccttgataactttctgtcttgttgatctgtctaatgttgacagtggcgtgttgaagtctcccattattattgtgtgggagtctaagtctctttgtaggtgtcgaaagacttgctttatcaatctgggtgctcctgtattgggtgcatatatatttaagatagttagttcttcttgttgaattgatccctttaccattatgtaatggccttctttgtctcttttgatctttgttggtttaaagtttgttttatcagagactaggattgcaacccctgcctttttttgttttccatttgcctggtagatcttcccccatccctttattttgagcctatgtgtgtctctgcacatgagatgggtttcctgaatacagcacactgatgggtcttgactctttatccaatttgccagtctgtgtcttttaattggagcattagcccatttacatttaaggtttatattgttatgtgtgaacttgatcctgtcattatgatattagctggttattttgctcgttagttgatgcagtttcttcctagccttgatggtctttacaatttggcatgttttttcagtggctgttactggttgttcctttccatgtttagtgcttccttcaggagctcttttagggcaggcctggtggtgacaaaatctctcagcatttgcttgtctataaagtattttatttctccttcacttatgaagcttagtttgtctggatgtgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacatttttttcttcatttcaactttggtgaatctgacaattatgtgtcttggagttgctcttcttgaggagtatctttgtgatgttctctgtatttcctgaatttgaatgttgacctgctttgctagattggggaagttctcctgaataatattctgcagagtgttttccaacttggttccattcttcccgtcactttcaggtacaccaatcagacgtagatttggtcttttcacatagtgccatatttcttggaggctttgttcgtttctttttattcttttttctctaaacttctcttcttgcttcatttcattcatttgatcttcagtcactgataccctttcttccagttgattgaatcggctactgaagcttgtgcattcgtcacgtagttctcgtgctatggttttcagctccatcaggtcctttaaggacttctctgcattggttattctagttagccgtttgtcaaatctttgttcaagatttttaacttctttgccatgggttcgaacttcttcctttagctcagacaagtttgatcatctgaagccttcttctctcaactcatcaaagtcattctctgtccagctttgttgaattgctggtgaggagctgcattcctttggaggtggagaggcgctctgatttcatagaattttcagtttttctgctctgttttttccccatctttgtggttttatctacctttggtgtttgatgatggtgacgtacaggtggggttttggtgttgatgtcctttctgtttattagatttccttctaacagccaggaccctcagctgcaggtctgttggagtttgctggaggtccactccagaccctgtttgcctgggtatcagcagcagaggctgcagaacagtgaatattggtgaacagcaaatgttgctgcctgatcgttcctctggaagtttcatctcagaggggtacccggccgggtgaggtgtcagtctgcccctactggggggtgcctcccagtttggctactcctgggtcagggacccacttgaggcagtctgtccgttcgcagatctcaagctccgtgctgggagaaccactactcttccaagctgtcagacagggacatttaagtctgcagaggtttctgctgccttttgttcggctatgccctgcccccagaggtggagtctacagaggcaggcaggccttcttgagctgcagtgggctccacccagtttgagtttcccggccactttgtttacctactcaagcctcagcaatggcgggcacccctcccccagcctcgctgctgccttgcggtttgatctcagacacgctgtgctagcaatgagcgaggctctgtgggcataggaccctctgagccaggtgcgggatgtaatctcctagtgtgccatttgctaagaccattggaaaagtacaatattagggtgggagtgacccgattttccaggtgccatttgtcgccccttcccttggctagaaagggaattccctgaccccttgcacttcccgggtgaggcgatgccttgccctgcttcggctcatgctcggtgccctgcacccactgtcctgcacccactgtccaacaatccccagtgagatgaacccagtacctcagttggaaatgcagacatcacccgtcttttgtgtcacttacgctgggagctgtagactggagctgttcctattcagccatcttggaatcgccccccgaaattggtttcttgagatggaaactactcatgctgaagatgctgtgaacattgttgaaatggtaacaacggattaagaatattacataaacttaattaataaagcaacaacgggatttgagaggactgactccaattttgaaagaagttctactctgagtaaaatgctttcaaacagcatcacacattacagaaaaatatttcatgaaaggaagtcaattgatgtggcaaacatcattgttgccttattttaagacactgccatggccaccccagctttcaacaacaactgccctcatcaattggaagtcatcaaaatagaggcaagacccttcactaggaaaatgtttccaactttttgaaggctcaaataatcattggcatttttttagcaatgaagcattttttaaattaaggtatgtacattttcttggtcataatgcttttgcacactaactagacacagtataatgtaaacataactttttttttttatttttttttttaggtggagtcttgctctgttgcccaaactggagtgcagtggtgcaatcttgggtcactgcaacttctgcctcctgggttcaggtgattctcctgccttagcctcctgagtagctgggattacaggcatgtgccaccgtgcacagctaatttttgtatttttagtacagacagggtttcgccatgatggccaggctggtcttgaactcctgacctcaactggtccatctgccttggcctcccaaagtgctggaattacaggtgtgagccactgcgcccgggcaaaacaaaacttttatatatactaggaaaccaaaaaattcctgtgactgttttgtagtattcactttattctggcagtcttgaaccaagtgtacgatatctccaagatatgcctgtacctgtcagagttctactttgcattcaattacagctattaatctcctgcaagtcattttgtctctctgaagttttttttttttttttcttaaataggagaatactatttatcaactcatttcatgggattattgtgatagtgaaataagaaactgtaagagaaaaccttatacttttacaaatctaattgcttttattatcattattgtgtatgtgtgtgtttgtgtgtgttcactgttaatctcaatgcccttcttactatttttctcccccttaaagcaaccttgttcattctcactttcccttcaggtatcagttttctaataccttcccctcatcaaagtctaagtagaaaaataagatataagctattgacatgttgaataaaaacagtgagtttctactgctaggaattccatatcttgtcttggccctatcagccttgaaactaaaataggaattttcagggttcttatggaaaggtgagtctaatggtttgaggcacacacacatatacccccattatatgatttatttcagagaaaatcatcctagatacagtcccaatacagtcagaagccttgagaagctgaaaattggaaggaaaatgtggatagtgtgtgttcctatgagaatttccatttcatcatacagtaaaagtctatgctggctctcatacatttctataataaaatgtatcatcaatatcatcaatgaaatatatatatgtatttcatgtatttatatatttcatatatatataaatgctgaattaaatataaaacttaagtatattacatatctattgaatactgatttcagcatttttggatttgaggcctgctgggagcactgtgttgactcaatctaccacattgcccaaggctggccatccttcacatagtcttacagctttctctgcccacaactccaggtgtctgtgtagctttgactggcatctctgcagagctgagggggctgtgggaatgctgtctttctccaggcatccacagaggggctggcttcaggtttagtttagtcccatagtccacttgtgggtcagagaaatacattaattaggttagctcctatgtgagttattgcttcgcaggttaaaatcattctgattctactttggtaatatgcaaggattttcaaaacattttctaagagtgtgatatgtgcagcaagcatttaaatttagatatcaaattgtttttattgaatttcaaactcaaaagtgtttctaaatattgtcattttggaattgggcccccaaaaatagtaaaaatagatgtttaggtagagaaacacatttgtgtagcaatgcctcaccctgctacagctcgttcgctgacactgcccaacaaacccactgaggcttggtgcgagaaattacctcattaaataatcttataaaaaaattgtcagatgtaacaaagactggactctctgagcttttctctataaagaatgcattgttaagttgatcgggttaaggttcagttagtccaaggtagggtttatgaataggaagaaacttgtcattcactttgtagatgagtaaagcatgtgaatttaggggaaaatatcatcagtcacttcctcaaattgtttttggaagtagcaaaatgtcaaccatattattaaataaggaaaccatacttcttaaataaacttccctagaagcagatctagagatgaggatttgatttgtgtgcaaggaatttatgaaagggagtgtgctaaggaaacaatggaagcaggacagggaaggagtcgaaggggagcaagagggagggcccaggcagaagtcctcaagctcagggcgtagatctcagccagtccctcaggtgtcctcaggagtgtcagagttttcccaactggaggagaaaaagctagactgccattttcccacccccaatggtcattggttaccagcatgtgtggaagatggcagtcctcaggcacttctggctcctggaggctctggaaggcaaagagaagtctgccaaagaatatcacagatgatggccattggaagctttccaagggttcaggttttcagaactgtttagaagagatgggaagagatttgggtcattacagcactggccgcagcactgtctgctatgtaagtgcatgactagatggaccttgagctattcttcaggtccagataagggatctatgtgtcattttaaacactggcttcatgtacttgcctgaccacaaagggcaatgtcaccaggaatataaagtcaaataaaatgggtcctgtaaaagacaatttgctgctgggttgcagtttaatccatgacctcttttgcttacatgagatcttgaaagaatattaaattaagagttatcttctatgctggcataagaagcaaataattttccataatatggaaataaaatatgtgaaaaatgttaagtttcttgaaacaagagtttaaccagaagttaataaacaactctttcttcaggaaacctttgactcatggtttatacatacttttgtattaagttgtgtagcataaaaataaaagtatagcagtagtatactaccactggagtgtcattcctgagatagccagatgttcagttattttgaaataaccctggagtataacagtaaagctaccccctcaaaaaagttttttgttattagaattcatgatattaatctaagttaatctctccattcctttgtgctcctcataacatgttgtttaaatgtctctacagtactgattccatcctattttatgttattattatcttgatggctgtattagtccattctcatgctgctgataaagacgtaccagagactgggcaatttacaaaggaaagatatttattggacttacaatttcacgtggctggggaggcctcacaatcatggtggaaggcaaggaggagcaagtcacatcttacatggatggtgcaggcaaagagaggagagcttatgcagggaaactcccctttataaacccatcagatctcgtgagacttattcactatcacaaaaatagcccaggaaaggcctgcccccctgattcaattaccttccactgggtccctctcacaacacatgggaattcaaggtgagatttggttagggacacagccaaaccatatcaatggcaaaaccgtataaggttcatctttagatcatccaaaacatttgtcactgttccagctcatgatagatgtttgaaaacatttgaatgcatgaattggcctacaatttcccttctttgaaacatcttgtcttttattataatagccaagtacatttgctctttgaataatgattcaccatacactctcctagctgcttgttaattcttaactttctctcccttgttcctttggaatctgttatcagtgtttcgacaggatgtgcacaagtgtcagagcatatgttgtctgcatatgtaccaaagaaggcatatctttctttccttttctctgcaatattcttctctttaatgcaactataaattcccagaacatacctcctattttgagccaagaatcaggctttgaataaggtttcgctcatgtagagtaggattctggatattcagcttcaatagtgaagctaagaattctacgtatcttttcctactagcttggaaaatatatcttaaactagtccttggctatgactttgccccttctcaggaatagacacagtgtgtttatgcaaaacaaacacagcgttttcaaagatagagcaagagaaaaaagagacttctctaataggctttaatacaagaatgaatttcatggatttatttcagagcaaatcatcctcgatgtggtcccaatacagtcagaagcctcgagaaactgaaaattgggaggacaatgtggacagtgtgtgctcctatgagaatttcagtttcatcacacagtaaaagtctatgctggctgtcataattttttataataaaatttatcatcaaaaatactaacaaaatgttgcaaacccaacacattcacagtcttctatagttttaaacatacactaaggtcaaagccaataggatagtcagctgctttaatttaggagtaacacgagaatgggccagcccctagtagctcctccattacctggtcatatgcgatgtccactatgattgcatcgtagttacactcctgggaaaacacacctgtatccgaaatctcccaaatagcaaatggtagctggaatagggaaataggtggctatcactgagtggaattaagatccctaagtaagtgaattgtagagaagctcatctttgatcagggtcataaaaaatctggtgctggaaggcagggattaggtgaggctgtaaaaccggatgccccaaagcaaatttgctttgtctttctttctcctcacagactcattccttatcttcccaattaatgctatcactgttctcccctggtaccaaagcttaagacctatgggttgtttggacgcctaactcttaccctgcttgtccagtcacgctctggtaattgcgtttctgctttattccggttgccttgatttaggatttcatcttctcccacttagttgagtgccattttctccttcctgacctctcatattttttgtgactttttttttccatctgagcagctagactgacctctcgtgtgttttaacgtcagtcctctcttccactgccagccatctcttcagtcccaggtttatctccatccctatctcctcccccagctccgtggcttctccccactgtctcctcctgtctttgccatggtgatggctactgtggagtggagtgttggttaggggccctggagccccacccttctagtttcgaaacccacctctgccttattacctgtgtgaccttgggcaagttatgtaatctctccaactgtcattctccttatttgaaaaattatactaattaatgcctaactcaaaagattattttgaatattaaatgagataatgcccataaagagtttagcacagggcgtgttatacagtgaagtattcacaattaccattgaagaaatttgatgattagcatttgatatcactgaggctaggagatgcagcaagaacttcagtgggtaaatttctaggcagacaaacaatattactaaaatagaaggtatatgagccatctgcccctttttacaaggtatatgagccatctgcccctttttacaaactacagaacatttaaaattaattcaataagcagaattcctggtattattattaaatatcaacttttcaattgacctggccataaaccatctgttggttgataaagacacacatcctaaacttacagaaatagtaccattattcaactttatatgccagtggttcatttctttaacaaatatgtagcgctctccttcatgctatgctagactgaactaattgttcaggacgtcagaggacaagtttagttcttgctctgagaaaacatcatctgtatgagtttgcaagggtttccataataaaataacaaagattggatggcataagcaacagaaatttattttctcacagttttagaggctagaagcccaagatcaaagtaccctcagggttgttttctggtgagggctctcttcctggcttgctgacggctgccttcttgttgtatcctcatatggcctttcctctgtgcacacctgctagacagagctctctttctcttctaaggacaccaatactatcctatcagggagcatgccccaccctccaacctcatttaactgtaattgcctccttaaaggcccatctccaaatacagacctccaaattggggagtagggctttaacgtgtgaattttgggggacataatcctgttcataacactatctaaccaaagaaccagaaaaatagaagatcaagggacacctagttcaagtttttaggtgaaccataacctacataagttaacataaaaacatttctgagagaaaaaaaagaatactatgttggtactctaactcaaagatcttggactgagaatcaggttgtttgtgttctaatcttccttctgcagtgaaattgcagtttaggcaaatcaatttctcaagtcattctgcctctctgtgactgaatcaaatgaagcctaatgatgcttataaagttgttttaagacataaaagagctctacaaggataagatgctgtcattttcatcactggctttcagctaaaagctcagcctgatatatttttaccatttcagggaaggcaatcttcctctccagttcaagtatgtagcataatatcaaagaatattgatgttaaaatgtggacttcatgatcaacatattgattagacactattttgaatatgttaagagagaaagcttcaacctacacatccctgtcaaccatcaaccaaccccaatcataaacatctttagcagaagactgaattctccttttcttgaaattccatagtgtgtgttgctttattccaattacacgatgtcttaacatgaaactgtaatgcgattttcattcagttcttaatttcagatagccagaatatatttctttataaccaatcgagaaatgtgactataatgaagtcagcattacttggtaaaaagatttaaaacaaaatgctctttctctactagtcgaactaaaacttgtctgcatagaggacatctgtaacgtaaaggaggtcaggggcatgcaatgaatcaattcaggagtcttcacaagcgcaatcattcttttctactaaactaaaattgttaagatccttttcattttgaacataatcacttttatagtttccaagtacaggaatctttaaaatctatagctagagatgtgtagataagaataatatattcaatgaacttctttttcatggggtgtaatctgtataattgtttaacacaaggaaaaccacaataaagaaatcatgcccattctctggggaaacagaataaaagcacacagggtcaaatatgcaggttctgtgtgtaaatagcactgatgaagtgcatatcttgcacattttacctttacgtgcttccttctgtgggagaataacaaactccctgcaggtctatagtagtgacaatgattaaaacttgggataaagcagaagaggatctgaaattgttagaaaaactctctgatccccaatctgtttgctctactgattgaaagataccagatttaccaacagctgaaactgatgctgggcttgaacacaggggagaatcaagcagcaaaactcagctttttctttcttgtgccccttctagtagagacagtccataaatatttactgaaggaacgaatgaatcacacagacggagcacagttgggcaagccagtctcacacgtcttccgctgggacgaggacgaaatatttataagtcgtgatcaataaaatcttccctacctgctacctttctcccttctaccccatcacgacacaaaaacctgctcccagttcctctgcttgtaccacctacaaggttttcctagttatcccatgctacttccctggggaagctttcttggccaccaaaggaaagaataaggcaggagttctcattgacaccaatgggaccaattgttttctcccatcactgctgtggttaccaccccaaccctgactgctgccttaaaatacacgcattttggtaagggtgagagaactccgttctacaaactgcttatagaccagacacatgaaatgtgcacagttttaccacactctctgagaataacataatatgccatgaagatcttcaaagcccacactattttattttccttctagttaatgatgccttgggctttagggccacagatctctcttttattttgctagttcagtttagtttccacctcaggccctagctgagatataaaggtatgcaagtagagctgtggagaaattgtgctgtgtgttctacaagaaagggtcacatttggcttttggttgcaaatatcctatttacttccaactgaaactcaataatacagcattctgttaattctatccacatgaactcaccgaccgcctcttatctatgtcagaaatacaaagtcctcctcagttcctctgaaactaattttttcatctcgattagcacatctaggagtcttcctccttcaatcatgtcctcctttgtgtcttggttttgatgatttttctcatcagtcctttccttccactctcaatcacatcagactggcatctcttcatctttcttctttctttttgtgtttgaaaccacaagtgtttttaggattccaagttgattgaactctactccatacatactccaaaattttcttaccaaattgtatttctattctttttttatggctgagtaatattctcttgcatatatacactacatttttgttatccattcatccattgatggacacttaggttacttccatatctttgctattgtgaacagtgctgcaataaacatgggagtacagatatctcttcaatatactgatttcttttcttttgcatgtatacccagcagtgagattgctggatcctatgatagttctagttttagttttttgagaaacttccattctattttccataatggctgtactactttccattcccactaacactgtttgatcgtttccccttgcccatatccccatcagtatttgtccccatacaaatttatttcttgtgtgattgacaacttaattacaatattatgacccttttctaatcagtctgggacaacttaaagtctgcagtggctttaaggagatttccttgagagcaattaattactgtgttgagccatcctgcccattttgagatgaagcttatcttgcactgtgtgaccctggccttgccagtgcattcctaaaatggaagaacagcaagtgaggcgtcagcagtcaatcacccgcctagcatgctcccatgctgaatgcttttccttttaagaaccataatcagatctaatgatttgcaagatagaaaagaacactctcatttatcttgcagagtgcatcaaggtatgtgggaaggatggagatataaatgcaaatgaccttgacaacaagctaagaaaaactagtcagaactttgaactcaatgatgtttaagaaagattcatgggttaagttgtacattagaagttttttgaagtaaagatatacaaaatagagtcttaagtcactccaaggtcaatggagtgagatacttactgaacatgagttaaaattgtttttttttctgatcatgcacattaagatgtgatgaatgaaaagtgtgctgcatagcatatgagagttgaaaggtaagtccaagacaccccctttgattggaccctttattggtacacttaatgataagtgacagaaccgcaactcaaacttgcttaaagaaaaaggaaattttaggtttcataaaattaagaagtctttagactggcactagtttcaggcacgagtatatccaaggattcacaagatgccattaggagcatgtttttctccctgcacctcaggtctacctgtctttcttgtctttatgctacattcttgtgcaaacatgttaccagcatgcctcccttgaactcagggctcctgaacctaaatttctctacatccaaagggctctgatgggcccatcttgggtcccatgccacttcctggactaaatagtgtgtctacaagatggaatattctgtgtgatggcaggcaggctcacctgatgagaagttctactagaattagggggaatagggaaaggtgctaggcagactgaaacaaaaaggaaggggaccagaggaaacatttcctacagatctgcatgtagggatctgaacaagacataagtcatctacgtggtttataggactgacaatgagtgagaattaagtggaaccttttaggttctgagatctctgtcaacgattggacaaagatgaaatatgaagtaggtttttagtttttgcataaaacaaatgcaattggttatacaatatttggggggaaagaatgataaaagtcaaaagaataaaataaaaatatgtaatctaaccaccataaatgtgtttggcaaatttttcttgcattgtatacaaatatgtgtttatgaatcagaattattcagtatctatactgtatttttgtttaaaatattgagaacattttggcatatgattaaagcagtctacaaaagttacaaaagttttaatggctaaataacagctcatctaatggatgtgtcgtagtccataatcaatgtctgttttacatatttaagtttcccattttttactttcataggtaatattaaaataaatattttgacagcacatctcgtcattttctgaaaattgaatccaactagttaaattactgagtcatagatatgaacatataaaagattttggtgtgtgttgtagcatttctatccataatattactatttttaccagcaatatgtggaacgatccttactgtttcccaaaaatgatgatttttcagctattatattgtgagatatatgaagcaagcattcttgtttcccccacaatatctactcttaaaatcacctagtaaacatttattaaattttaaagaatgggccatagcaagtatatgtttttaattctgcattacaaagccaaaagagagagtctgtgttaatgaagtaaatctctgcttattttaatatcagtaacactcattgttgaggatgtagagaaatgactcttctataaaagcatagtatttcatctggcaattgaagagatgtacatcttaaccccaaaattatttatttggaattatatccaaggagatgtttgatcaaatacacacaaatatatttgatatttatcaatgagatctttatagtatcagaaatcttaaagttatttcattacccatctctatttatttaaaatagatcctagatattcattcagtggatgcaatacagccattataaaggaatgccttgagttaaagttggctgtattgaaatcttgttccaccccagcccaccaaataccagccttgtgcccttgcacaaatatcttgtctgtgactgagttccgtaaaatttattttgagcattaagttggattttacatagaaaaaccttaccaagttctaatgtcaaaatttttataatttttattaaatggaaaaaatgttgatgtgaacaagctatcaaatagcatggctaagaatatcccatttacataaaattatatatgtgtatgtctgcatagagatccagaataacattaatcaaaatatgaattggattatttctcatttggagaacattgggtggtttttgctttcctctttatatttttctctattgcttgaattttctctataagtatttattatctgtatgatcataaaaaagttaataattgcatttactttttaaaaaagtcaaattatgtaagaacttctttagaaaggtctgtacttcataggtgactttcccaaagccatgatgccagattgcttcaggatagcatgagaacaaggtctactaatttttgttcatatatttttgttttactaatttttgttcaagtgcctgctatcagctaaaatgatcctgggcaaaaggaaccagcaatgagcttaggctacaacaattagaaaattccaggctttggctgggtgcggcggctcatgcctgtaatcctggcagtttgggaggccaaggcgggtagatcacgaggtcaggagatccagaccatcctggctaacatggtgaaaccctgtctctactaaaaatacaaaaacatttggctgggcatggtggtgggcgcctgaagtcccagctactcaggaggctgaggcagcagaatggcgtgaacccgagaggcggagcttgcagtgagccgagatcgcaccactgcactccagcccgggggacacagcgagactccgtctcaaaaataaaaaataaaaataataataataaataaaataaattaaaaaaaatttccaggctttgaagaaaaaggctagaagttctgccacaattagctgtgtgaccttgggcaaacctcatgatctcccagatcctgtcttttattttctttttatttccaattataaaataattatctgaaaccttctgtacttttaagaacataaaatgatccgaaaactgatgtatttatttatttagttgctagtaggtggttttaaccaaatctcaaaatactagccttggactaagtatttattcagagataagtggaggaattaggtggttgacgtgaatcttcaaaggatgaatttagttaaaaaaaaaaaaaggaaattagtctttaaaattatagagaatttatgatctggaaagtttgttcaagctcaagatataaatagatttcataaagtttcagataagtatgccataggttactgagattttattgctataactcttaaatttgaatcatgagaggcaatcatcgtcccttaacaccaagatcaagagccagaataaaaggggatgaaatgtgtgcaaacacgagctgtccattttgtgctacacaatagctgagtatgtgttgattctttaataagttcgaatgacgacatcaaaaatatacacagcctatgataatcacagccccgaacttggatatttctctaattatttttccttttctcattttactacaaaaatactaagaaaaatacatcctcttaggtacctgcattatactagttactatgcttaggggttacctgtattacctcatttaatccttacacttgactgctgggatgatgttattcctatttacttacaggagaaaatcaagaccagagaggttaagtgcatatacaaatccacggttggaagcaatcgagctggaatctacacacaggttcttctgattagcaatatgtcatccacagttcctgacatattgagctattgctatgtaatgaaggtcacagtgactactgtggagcatgtgagaaaatataaaattacttatctaactgatgagtctaatgaacaccagacgatgttctctacaatcggtttctttgatacagatacgtaactgacttcctttttaattgaacagaaggaacatattattgactcacataacaagggatactttcagaatgtatagtaatttgttctgtgcaagaaaacctgtttggggccacactttttttctgaagggtaaccttcaaggtattttccctgaaccattttttttctctacagattatagaggatctgaaagactaagataaagcactcccattagaagctgtgatgacagacgaacgagttgaatagtgacaggcagtgttgggtccttttcctatttctttcatgaaaatggaaccgtcgttcattcaaccaggagcctggtcaatacggtgagctcctgtgtgtgtacaggaaggggcctttgataattgcataaggcagacaattcatctggaagctctagaaaataagaggtggaaaaatgagctctcaatgtccacctgggttttgaaaaggtagatatttgaagttgtggcaggctgctttgtaattaaactggtcgctgaggtcagttttcatagcagtccaattccagatgtgatcatagcgtcatgagccatgcctttataaatgttacatttcctgggatcaaattatttgccagaatttacttcctaatttaaagagtttaaatgccacattattttgaatagtattttgctatactggtgtttttgtgtcatggaaaacagtcagagggcatggcatggaatagcaaaaaaaggaaaacctccttccaatttctgtagagcagaattcactgcattcgtatcctgctgtccagttttgattcaactggaccaatttctcttttagctactatgataaatgtagtgtttactgaaaaaagctgatcctattttctactctcttatatacctatcttgaagcgtcagaatgctcctgttatctggaaacataatccattatacatagaggttctttctcttctgtgatttgaacctagtctttaatttatttctattttgaactgaatgtaaagctgattacccatcagagaagaagactggcataatcaagtaagacaagggcaggctccttggaatttttcttggatagcttttctaatagactgaaactaattctgagactctacctgtcactatgcacagcgcctaattcccatgcagctgaattagtttgtgtgaaatactctctttctgaggccctagtcacttagaatttatctcagctctgaagcaatgactgttaataacctgaataattgtggaggcattcccctgtactaaaaattatacgcagactaaatcaccacaactcgattatgatggatgcaattaaaataaattatgtaaatgtactataagaataattagaactagaaatgttgatgagttaattgccatgtctatgtacttatgacacagaaatcgaagaaatttggaaaaaatttagattatcttaaagataaaacagatcaaaaagcatgaaaaataattcggtaatggggacaagagaagtctcttcttgacattcactcaggactttgcaaaagagatgaaggtcgcacaattcactacatggaatttagggacttgacaacctgaaggctgagtgacaaagaggcttcgtacaaactaaaggatgaattaggagacagaagtggctttactgctcaataattagaactttgagggaaatctaaggtcagaaagtaatggttaacgtggattaatatatattcaaaaaacaaacttttaaaagaataggaaacataacatcagtgtgaactcaggcttttgtccctcacttttaagctgtgtccgttgtctgaaagcattggcaaccctgcagccctaagtaccactgcagccctcgtttcagctctaaatacaatactgaggcaaatggtgtcatctaaaaaaaataaaaataaaagacctagaagccagattaaagaggctcctgcagacacaggatgagacaaattgaaaatcaaaaagaataatggctgcaactgattaaaacaaattatcgctccatcatttcataataacactcaaaaaaggttttaaaaatttggagcaatgaagcaaaatgtactagacacttttggaagctgctaaggcaccaattcatcatcatcttaaacttgatagttacagggaagagtaagcttgtattctgtccttttagtagaaattgttctttggactaaccaaaagaacttaagatatcagtgaagttttcaaacaggagaaatggtagaaataggaaagcatcattttgtaacttgcagtgaaacaaatttttaaaaacaaattaaaaggtaaaggtgtagttctgttactgctttcaagaaacaagggatatgtaaaaactaatgcaatgagggaaacatttttggatcctgattcaaacaaactattaaaaatattgtttagacattaggggatgtttgaatatgaatcatgtattagatgagaatatgggtttttaaaactaattttagtaaaagaaataatgcattgtattacataagaaaaaaaattttaattcatattgaagaatttgagtaaataacttgatatttgaagttttattgaaggtatcccagccaaaataaaatgggagcagggagaatagacaggaataaatgaaaaaaaatggcaaaacaaataatgtttatgaggcttagtgacggatccatgtggactatattttcaactcttttgcatgcttagaaattttcgtaataaaaagttttttaaaaatcaaaacactgtttaggcataaacacagagagacagacaatagaaggtaataaattaacgtcaattgccattatctattgatttttatgttccctgagatctttacataaaattcaaggttgtaaactctaaatagatgcctacacatgtagtaaatcgggtgaaaaatgagaagtagcagggagttgtgacctcaggcagaaaaattaaccctgctaacttggatggtgacagcttaagtgtatgagtgataagaagtgtcagggagactttagcatagtgacttggggcactgatcttcctgggcatcacctctgtaggggtgtcagacatgaggtagatttgaagaacaaaaacaaaaaagcatattcctagataatttgtcacatttcaaatgtttactgttcggttctgttctcaaaagatccaccagcgttaatagcagccaggcgcagtggctcatgcctgtaatcccagcactttgggatgccaaggcaggcggatcacttgaagccaggagtttgagaccaacctgctcaatatggaaaacccatgtctactgaaaatacaaaaattagccaggcatgatggcacaagtctgtagtctcagctacttggaaggcagaggcaggagaattgctgaacccgagaggtggaggttgcagagagccaaaatcatgccactgcaccccagcctgggcgacagagagagaccctgtctcaaaataataattaatcataataatattgatagcaaacagtagtattacggttaaagccagggccagcttcgtagccatccagttcgcactggttcctatgcttagaaagatcccacatctggtttagtgctgtgctgttgccatcttgggatttctagaaattttaaacaaggagcctcacgttttcattttccactcgacccttcaaattatgtcaaaagtcctggttagagtggcttatatacaaagtttgtagggagtagatttagtgaacttgatgaagttttatagttcattctcccgaaggagacttgttagtcactgaagagtcgcttcacagtatttatttttctttttaacttcccaactcttttggggacagctaagtaaacacagcctctagcagtatggtattacttgggacaatattagcttcataacaatgacacacaaaagcaacatccaatttcaaaacgtgattgttctctagatcaagaattttgttctgaaatataattttcagatataggtgtgcttgctgatagttctaaaatattgagcttgatataaaggcaaacctgtctaaacatatggaattcttttggtagtcttagccatgctaacaaatatgttttctgactacagcttttttttccccactgataaaggaatattttcaataaggaaatgatagcaagtcttgtagttactctttggtatttgcaaggtaataaccagctaacagcaatgtatcaatgattgcatttgtgtagacatcttgaccaaagtcacacagacagtagcagaaagtcacttgtcactgtgcagctggcactcttgcataataaggattaggatagccgatgttttgtcacagtgccaaagttaatcatggtctaaggacattgaaaaaaagctgagaagtgagtgaattaatcatcattaaaaacagatttaaaaagtaatcctgaaggggaacttttaagaaaaaaatactactttgaataatacaaagttctttcaatattaaaaaaatgaaagatgcttctagaagggactccttcctctaagacatcagtattataactgtaggcaggaaatcattttctagaaattaacctttcagggcaattccatcaaatcatgagtttttattgctccaaagaaataaacccttcatcagaataggattctggatccaagtctctttggcatcctccctttagtgtctttatcagagttagctacagaacattaaagttccagaatacttaagtcagtctgtctgttagacttggagggaggaagatgattatttaaatagtcagatagttgtagcatgaaaacaagttattaaacctctggttgaataacctctgaaaaaatgcaaatgttaactttgagaccgatggaataatgtcaccctacctgtttttaatatttgagaatggacacaagcaaggggacataagggtaccttcctcttgccccctgcaaactggctgccaagggacttgtaatgatggcagctgctttgggacagtcaggcaccaatcctctgcccaaatagtcatttgttcttccactcctaactctttgcttgcctgacattttctgagagattgcactatttttcttttcttatgtttttcactcattttaaagaacgcttttttctgaataagctgtttccttaaagtattcaaagaaacaaaattccaggcagaaggaaatttgcattctgatgttgtttagagttccaaagcctgatggatggctgccttctctgtagctcctccaagtcatttcagatctacaggtgcttcatggcctgtcctaaacctgtaagacttgaagtcttataggcttgacttgtaccttaatttccacctccttccatgtaaataaaataaaaaactaatgcctacattagcactggataatcatgaattgttgtttttgttctttttttttaacgtaagcaaatttaaattttctactcttatttctctcagttggctcttgtgtttctagacatactccatagttggtttccttagagcttcaggtaaaaatcttagcctggatcttaataattatacctgatggaccaagagctgggttcagtcacatattgtaaacaatcaaaagctaacttatgaacatatggcaaatgtaattctttgataagaaacaagacagcaagttgccgtcttgattacatagatgtaataggattattgtctttagctatctgttcttgaagtacatacgtagcactttatcaggaaggcccactgaaaaacaaacatgcaactctggaaagatagatttgcttcaaataattaggaaatagaaaaactgtgatgaaagaaaaatagggaatttatttacaccttcaaagtctcttagaatatgtcaagtaaaattgaaaacgaatcaaacacggaaaagaagcaaaattcttcgctgtaagatttcaggaaatacctagctgctaagattcagcaatttaattacaaaactggcacaaaggcacaatttagttgtggtgaggaaatttaattctcctaacatcagctaaaagtctgtttctcgaaaaattgggacacctgttaactgttttacttatctcaccgaaaatgtatctcttaaaagattactgataatgtcacactctcttttctttagttccaagaagttcatggcagccatcatgccaggcaatgagaggacattcctactgctttctctcccctaagctctggtttagtttctgatgccctgaacatcaaggaagagccaaatatcctggccaaagctagttcagctgtgacagttggggtagggagaggtgacgtagtaaggatccttgaccttggttttcagtaagttaattaaatatcttatgactggacatggtggctcaggcctgtaataccagcactttgggaggctgaggcaggcagatagcttgagctcaggagttctagaccagcctgggcaacatggtgaaaccccatctctacaaaaaaatacaaaaattagctgggcatggtggtgtatgactgtgggcccagctacttgcggggctgaggtgagaggatcacttgagcccaggaggcagagattgcagtgagcccagattgctccactgtactccagcctgggtaacagagtgagacactgtctcaaaaaataagtaagtaagtaaataaataaataaaattttacttctagcagccatgggcatttgcttcaggttattctgaagaacaatgctattctttttctttagatttccttccagaaaggaattcttcttagtttcccgttcaatctctcaaggtaataaggtatattttattaccttatttattgttttctatataataagcttttcatgaaggcttaaagagaaagtacaaattattattgtttttctttgacatttacatccacttactgttcctaaggacaattcagtccctcctcccatgcgtaaacctttctatctgattagatccaggttgttactgatagacataaaattattttataaaaagaaattatgttcaatgtaaaaatagtaatccattttaaattcccttcatttctgcagcctgtttctccagacaactcaaaattgtctgaatcccataagacagtttctctgagcatattgtttaatgagagaaactttagacattctgaataaaacaagggaattactgatgtcccaatgctctttgcaatgagtacctccggtttaccattgtggaggaaatattgcattgactttctaccaaaatccatgtcttatctggaagaatgcctactattcattgaaaatcatttccagacctcagataacacaaggaaccagactgccatatcagactcacaaaaatcagagctcttacaaagtatccagctttcctaataattcaaaggatgcagatgatgataaaggcaattcacaaaaatgtctgcgatcactagtgcagctcctcacatcctgtgccacacgaggatgtgggctggtccagatttaatgtttgaggtttctaagtgatgcatgtaggccatcgtttccacaaggaagccattgtggttacgaaacagctccatttgtttgctccataattatatctttgacctaacattttccactgggccatatcccacaaccccaggagttcttcattcatttgctgtaagcaacctagacagactagatacaccccgtaaaaaggatgccacagaaaagggtctcattacctttctgctagtaaataccttcaggaggcctgattagtatgtttccaaggattctttactgggtcatttctctctctctcttcctctcccttctcttcttggacgtcctcagagaagacacgatgggttactaaataagcccaaaccctttccttctcaagaaccatttctatagcaaatgttattacattatgaccttttttaaaaatgtgtgtgcccctctccatatgatgatttatcatttgtaacacactcagagtgcacaaaccatcagaaatccttatctactatggtaaaatttgagcttcacgggaaaaaaaaaaaagaattgaagaacttccaaagagttttcccctcgtctttgtgactggttgcttttactaccctaggaattaaatgtgatttttccctttaaacgtcagatttgggagtattgctccctcttctgctctcagcattcttactcaatgattagtcttcaacattctcacatactctcagccactttgagtaaacgaagatacatcattcaggagtgagaattaattgtaaacaaaatatttagatttaggaagattaaacatttttaccagagttatacattacagtttagaacattaataaatcattgtggctgagttttacaactgtttcagtttcatgtcaagccatgtagataatttttcctggccttctgctccttagaatgaccaagtcctttgaggctgaatctcaaggcaaatggagaaatttcttggttgaagtcaaaccagctgacttaggtagttcttgttcatcaatccattaattcaacaagttgccattaaaccttgtgctctgtggacagtattatcttagattttgggaatactgtaggaagcaaggcaatcatggttctggtcctcatgattctgacctctttataaagacctatagaagaaatcaagaaaacaaattcaactaaagtaattacaaattgtgataagccaaaggatctttgaactgggctttttatagcagttatattcttatgaggttattcaacaaagataactagcacacagaagaagattgcattatggattccggctgctggcattatagtatatggcttagattaattttcatgagattcccaaagaatgaaattaatcatccagtaccagagaaaatcaataaacttcaagctgctttgaaaatactaacataagaaggttaataccttaattgtaaagttatctgaaatggtattaatgacaaatgttttgtctcttagaatacacattggaaacttcctgaatgctgctgaaactgacgtgaattttttcctttgcataatttaatctttagatagtagattccaatcaagattttctgttccaggtacatctttaagcctaatcactttcctctttcctgcttttctcttcccaactccaagcacatgcctgtgcttataaaaaatgacattcaagttctgttttgaatagagtaaggctttagaggtttccttcaaaacagaaagccccgaagtgcctgtttctgtatattcctcctgtacatcctcctgtgcttcaacaatcaccattttaagtacctgccattaattcatccaacccttaggtatcaagccccagtgctgtagaaggctcaaactaggtggttgggggattattgtcacagatgctgtactcgaggaggatataacttcatggggaatatataaataataatagcaccataagttatatcttatcaggcattgagctgtaagattggagaggatggtaataattgtgtatattcaaagtaacacctgaagatcttttaattaatccacaaagcacagaatatacagttctactcacagattaatgatgatctaatgaatccattaaggctagattttcctctgtcgctggaacaaagaacagattcttcagtcaagcaccaaatagagtgggtggctatgtttatgggctatggcatatgaaaaaaaatacatgcatgttaatgcaaaagtcagtcttagtatattaatacagtattagtatattcatatactaactccatgagagacacagggagctacgatgaagacaaaagtaaacttagaatttccatcatagtctcactaatatttgaagtgtatatactcactgagtagatcatgaacacatttatttttctctaatatgtttctctctctctctctctctgtctcacacacacacacacacacacacacacacacaccattcgggtcaacagaaacaacataagaaaagtttcagaaagcataaattaagtgacatcaatggagcaaggaatatatgcaattagtaatagaaaatagtaacaaagtatagctgaaaattcatatagaagaccatgaatattaagcaaaatttggactatattcagtagtttatgtaaagccactgaagatttttgaaacagatagtgacattatgagtttgctgaaaggcaaacaggatgagttcagttgtaagcctactgaatctgagctgctgcggaggcaattagatgcactcatatctagctactgggaagtcctaactagagatgaaggctgatgagccatttccagatgcttttttttttcaatctcttcagtgcctagaacagttccaggcaattaattaactggaattaactgttaattaactgtgctcagtaattaactactgaattaatagtatttatgatattaaggatatgatgcatacataactaaacactgaatggaagaatagatggatgtataagtggggggagggagggagggaggaaggaaggaggaaggaagaaaaggaaggaaggaaggggaaggggaagaggaggaagggaaggaagggaaggaaaggaagaaggaagtttgcctcttgaatttttctagtctgaacctttctactaaatatctattgtgttgttcgacagttatttgtaaacatgaggtcagattctgggcaactttaggcatctcaaaagtttgttgtatgtgcaatcaagagtaaagatccggctgggtgcgatggctcatgcctgtaatcctagcattttgggaggccaatgtgagcagatcacctgaagtcgggagttcgagaccagcctgactaacatggagaagcccccgtctctactaaaaatacaaaattagccaagcatggaggcgcatgcctgtaatcccagctactcgggaggctgagacaggagaatcacttgaacccgggaggcggaggttgtggtgagccaagatcatgccattgcactccagcctgggcaacaagagcagaaactcagtcaaaaaaaaaaaaagaaaaaaaaaaagaataaagatccatgagcagccaatgattgcagctgtgattgaatcactttagttatgagatgcaggctgtttggtggtgaaagctgtggtgttgggagaaatgagagggagaatacgatactttacaaatttttctttttttttttttggagacggaagtggcagtaggaattagaagagcatcttagcagggcatgccttctgacagttgcaaagaagagaagcagctaaaagaagactaaaggtagaacagctctcctctctggggaggcaaagagccgttaaaagttgtcagtcacttctaaggctagcactgtgtttgtgtttctctgaagacttattacatatggcaagttctacgaactggaaagggggtcagaaaggcattgactataagggcaagccaagcccttcttgcttcagtagtttcctggggcatgactgttttgagacagctgaacacttcagtcttcactctcactacccaacacagagcagcagtgtggggagctaagtcaagttgagaagaatattcttgcttgctggactgagagcacaagcctcaaaacagagttcagaggatgttagcaagtatctggcatccctgccttctaacctgcaggctcatcttgctgataaggtgcgtgccattccagttcctgggatcagtccagtgctgagtcaaaacagaaggagctcaaatttactcttggttgcaccctgacactgtgatttctgggttccagcctttattctgtggccgtaccttatactttacctttgctgtgtccatagctttttcccttgttctcaaatctctatctcgtgtattccaaccctgtttgctatgggttattttcttaggtacttggtgtcttgccctacaccatagctcacaggtggttcttggcacctgccatctcagccaccagagcccagcctctacagtgtagagtccctccatctaggagggtcaactgctcctcagtggcccttttatttggctattctattactccaactaaaactctcctgctcagctacacctcatgtctaattttgcttccactccaaatacctaattttcagctataagctgaaagcacactccaaatacctaatttcactcttgaggcattttcaatcctccctgattttatcttctctgttatcacctggattcccagattgacatggagaaagctatgatatggctccctcctatttcctagtggaaggcaaagggtgcctgaatcacaaagttatgttaaccttaaaattgaacatagaattgtctacataaattcaaaaggttgaatgtaggaaaaaaaatggtgagtcaatataatcttggtttatctctgtaatataccattaaaactcactgagaaagatcactagttaaacatattgtaaattctggaaacaaaagctgctgagttctgctgaaatagcccaagagtaaatcacaacacctacaagatgttttatgactaagttaatttttttaaaaatcagaagtcatcatatctctgcttggtgctaactaaaaagccagaagttttggtcagaacaaatgtagttcacaaacactaaggttttggttgttcaaaataaatcacaacaccagaaacttagaaataataaatataaacatagagccctcttttgtggcttttctaaacaacttatttctgataacttcataatgctgctgaagctggtcgaatttaattatgcttgtaaagtctactcatttgtacatgggtaagtcaaacattctggttttaaacagagtaagaatagttttctaaaatatgtagtcagtcatgtcaaacctctggctaaagtactgttattttggtgcacatattctgagtttccatgaaacaaaacattcaacacctatgatattttatcatactcagcagttcaaaagtgccattcatttctgaagagcttgcagagtataagctccatgagagagtggagagagtgcttcaagatatattctctctgtacccctaccagtgcccatctagaagacattcagtaatcacatggtgaataaatacatggaaataaagtttcatatcaattaatcattgggcaagagaatgttttctggctgctttgtccattgttaaatctactatgagaaatttaaaggtaacaattaagatgagacccagaaaagcactcagtgtcatgagtcagcagaggaatgtttttgaaaaccacagtgatataccatgatgcatcccagaatgcctaaaattaaacatatcaacagcagcaagtgctggccagggtgagaaatagcgagttatacatcgccgtttgggatgtaaaatgttatgaacactttgagaaaccatttatgattgcgtataaagtaaaaaaaacatgtggttatcattatgatacatctattttattttcaggtgtttacccaaaagaaatgaagacatatagccacataagaacttgcttaatttgaaatatctcctaattataactaattcagcagtttattctaaatcaacatggaaatgaataaacaagggatgatatactcgtacaatggaatactacccagccaaaaaagggaggaaagaacaaactgctgacattggttacaatatggatgaatctctacaacaccatgaatgaaagaagcaaactcaatgtagttgacactacgattttatttatatgaaattctagaacaagtgaacctcatctatagcgatggaaatgagatcggtggtaggctggggccaagggtagacagaattgaccacaaagaggcacaggaagtttttggggttgatggcaatattaaatgtcttgattgaggaggtgacacagatgtatgcatttatcaaaactaattgaactgtacactttaaatgagtatctcttatggtatgtaaattacacttcaataaagctgattatacactaaataaaactaagacaaatttggaaagttggtacctatgtttataattatagacttttaaaatatattctattatgaataatgcttttagcctatggaatcaattcttcataaaaactcattacataattttttgatattgcttgtaaaatcattcctttagacctattgagtaataacggtgtaggtgaagtagaagaaaggttatatgttaacaagatgtgtccaggttgatcagtatcatgatttatagtcctcctctggtatccgtgagggagagggagagaagggggtagatattgagtctgattcatttattgacatcattggaactttctggattgtttagtgtgcctatggtcagtcttaatcctagccttaatcctgaacttttcaagtacttgaagcaataaattctatttttgcttaagctaattcgtattaggtctctgttcattaattcttttgtacaaaatttcgaaggaacggaaaatttaatgcattaaactacacataaagtttggtagatattttcccccaaaatactatatcttgttctttctcctgtatccctcatctgttctaggtaatcaactaatagttttttatgaataagaattaaatgtttctactttttattgaaagatttcagattactgaaaatgtgacaaaaaatttctaaaataagcatagatgttccttctatgaaaaaagtactgacaatttatctgttgttaaatcatcaatatattgtaccagataccattatttactccctattgacttgttgaagtttaactaaattaactatacttaatccatttctaccctaaacatttatttgaaatcattactacattttaaaacagttgcttgatacaaaagtattttctccatataaataagggatacctttaaattgtttacatttgtaaagtacaatatgtaaacagaattttgaataaattaagaatattttcactgtactacctaaaagcaaacaaacaaacaaaacaaaacaaaacaaaaaacctcaaacgcttctcagacttgcagtttgagctaaataaaccttctttattttggtgtatcactgacagctctgagttgactccaggacaattagaaagaaatttccgtaatacatataatttcctaaggtacaaattttgaagtaaataatggatgccacaaatgtaagttggtcacttatttcttttttctcttgtccattatcttcagatgtgtaatcatttgcaaatatatttactttcaagaaaagccctttttattttactgcttattattactgccactaaataatattattgtttatagggctgtgttctatgctttaaatgcattattatacttaattttccaaacatacatgtaagacagatggaggagattgggagtaccgagagaatgaaaggtgaggctgaatccatagtgtttgcagtatccagataggtgaagtaagaggtgaagtgtcttcatgtgagaaagaattggtgtacttttcagagaaacaaaggctttcttacaggaaaaataagccacagttatagttgcatcatttgtcaagagatttctaaagaatctttcaagataggaaatgagagaaagagaaagaaaggagattatgttttttctatgggagcctgtaaattgaactgaaatgaacagtccataaacagaatggaatatctagggtctggatcctagttccaggcagcttatcacctgctcccaggcagcagaagaacctgaactattccagtgaggaaacaatgctttcactcttgacagtcttccctaaacagtagcaaaaacttcctttcagaaattgaccatgatatcctcaaagttttggtatcaaaaggttttttatctaatgtctcatctgaaaaggttgaagatcacagaaaaatttgagtacagaaatatgtttacaatattactcatcagaaaacatatctatagaggctaaaggggttatgttctgctgctttgcaaaactcagagaagctgagtgggaaggcaaagagttcagatcctaaaatgaaaatttgtaaatcgggaggaagtgtatggctgaacaattcatattaaaatgtatcatgaggccaaactttttaatagtaatctattcatgtcctatatgtaaactctttactatattagtgcttagagcataatttgggcttaatgcatatagattgattgagtgactgaaaagataaatgggaaaaatagaagaatacttttttattctctttctgaacttttgtcattaaaatgtgtatttatttcttatgttcccactgtctttaaaatagcatttctttaaagatgattcatttgaggccacttgtaataggacaaaataagcaattgatgactgatgtgcttattaatggcctcgggtgtcacagaaaacaactgaggcttcaggcaattcatctttaatggcattaatgataccttttgaaggtgtgattactactataaaccagagtcagttgtttatttcaatttattcttcagtatgagctacaaaaaattatgaactgaaaacaatactttagaaaggcagatactcttaaaattagcaaatagctttgctaaattataatataggtcattactgaaaaacacagatgtaaaattccacttcaaagaaggtactttattttccttttccttctagtttaataggagaaataagagattcttgcatcattttaacaaatcaaaatgcaattattcatagaagaaaagcaacatgttaatctttcttaaatttcttaaatgagtacttttggaaatgaaaatgaaattatattagcaaaaatttaattagcacatgtggtgaaagattttatatgattcagttagtagatttggtcaatttatgctaattggcaagtaatacaatagaatcaaattatgtatcatcagaataaagaggaataaacattacaataacatttttcaagtatactttccaaaaggtcatttttaaagaattcgccccttctgaacagcacatactatgttcgctgggagctgaaagagtgtgtcagaattatctggcacttaaacaccagcaaggtgtctggaataactttctcacaagaacacggtgtaaatatcatttttcttctgtttgattattttgaaaaacatgcatacttcatgtgaactatagtgaagtgtctgattatccaaagaaaaagccaatatttgaaaaggtgttattcacaatagagccaaaatagaaacagggtaaaattttgatggaataagtggtagggatgaaggaagagcacagagactatgcttgcatttaaaggcaaagcatacagtaattataactatatttctaggtgaagaagctgtggatgactagtatatttttctccacaagatatctataaagaccattgtttggcttgtattaacatttttgtttgcataatctgacttgggcaagatatgtataagaaatgcttagctataaaacaatagactaacactgggagagtatgggtgatggagtcctctgggttacacggcatgctgtggcatagtgtcctcagctgcaaattagagatgatgatcgtaaccaatttctaggagtgttgagattaaataagctagtacacgtaaatcacttagtatagactcaggaaatgttagctcttaatattttgactctactgacttttttcgtttatttttcctcaacaaagaggacatctttaaagatttgttcattgtccttatgtgtgtgtgtgtgagagacacgatatacacctgtccttttgagcaagagtcaaattctcattgaggtcaaggtgtaatttgtagttcaattccttattcgtaaccattgaatgtggctctgccacaccaaggtaaacgtcttgctgtctccattatgtgcttgggttacaggttgattacacgtgatctatgataatctacaatctatagtctacactactatagtgttgttgtttttttaaaattatttccttgcctaaaagttctatttcaaagttgcaatactgcaccataggtttccctctactttctgtgtaacaagatgagaaaaaacaaaagagggaggagtggggaaatggataagataaacaaggatttttagtttccaaagaaactaaaaaagtcattatagaattaaaatatgcgctaatggcgataaagagtagaatggaactgtttgtgtatttgctttgtggctttctatattttccaaatgttttgatttactatctcagaatagacttagataataaaagtaacaaaaagaaaatgagatttttttaaaatatcttcacaatgatataaaaatatcaagtaattctgcataatctaatggatgtgttagttctctaggggaaaaagtataaaacttaatgagagatataaaagatcgaaataaatagatgaagtgtgatcatggattggaaaactgaacattttaatgatgttactcttccaaaattgatctgtagagtaaatgaaatagcagtctaaattctaacaggcttttctttggtgaaaataaataagctggttctaaactgtagatggaaaagcctagggccaagactagccaaaacattctagaagaagaacatggaagaaatctttctaccatacataaaagcttattgtaaagaaagaatcataatgaaagtgtaatttggcgtaagaataaacacataaattaatggaatagaatagaggactcaaaaattgatatatgcatttataaatgctagatttataaccaaggtagtgacaaagagtagctacagtaaaaataactatgttttaataaatgaggctgagatgaatcggtgtacatttgaaaaaatgaaattggcctgttgcatcacaccatatacaaaaagcaattcttggttgatgacagattgatgtgaaaagtgaaaccataaagcttttagaagataatataggaaaaatcttaataacctcaggttagaacatacttttacacacaaaaaagcacacatcataaggaaaagaactgaagaactgtgcatgaaaagatgctacaaataaagtagagaggaaagctatagaattaaagatattagcaacatataactctgacaaagaactctcatccctaagggggctgaatgagcctttgtggttgattcgtgggtgacatttctaaggcagggaggctacagctgcaagaacaaagtgcctttctattttgttaggccagtggatttgctttgcttcttgttggccttccacatagaggccacaggggcattgtacatagttgaaatttcgttcacattctgacattatatagggtttcatttctcctttgcagtgctgtggttttcattttttctttgtgtcttcatatgtgttttaggcaggatttgaagttgtctggctcaaacttcaagtcagatgcggtcttaaccctttttttttctgttcctaaaatctttttgtaatctttactgtagaattcttaatgttgacataaatttatgaatttgatatattttgtgttttcctatattctctgaaaattatatcacaatattcttctgtattgaaagatagtcctatataatatttctaattgaataattacaatttctttgttcaggttgtaagctaactaatttaccattcccttatcctggggcattttagattccctttttcataaagacaaaaaaaatttcagtgagagacttcttgaataaaacttacaagccataaaattatattttagataagttctctggagtaagataactaggtcaatgtgtataagtaattgtatgcttttaaaatatcttgtaattggccaggcatggtggctcacacctgtaatcccagcactttgggaggccaaggcgggtggatcacgaggtcaggaattcaagaccagcctgaccaacatagtgaaattgcgtctctactaaaaatacaaaaaccagcctggcatggcgcctgtaatcccagctactcgggaggctgaggcaggagaatcacttaaacccgggagttggaggttgcagtgagccgagatcgtgccacagcagagtgacactttgtctaaaaaaaaaaatatatatatataatatatatattattctctctctcgctatatatatatatatatatatatatatatatatatatacacacacaaaaaaaaaaccacaaaagaggtgatttttttccttttgccttgtttctcaactcacagagttgcacagctgcacagttccagtacgtgaattgacttctactttaatttatcatacctgattcagtaagtgattctgtaacctttactttcaaacatctctgacaccattgccttctttcttctccattgtcaccttcctccccagtgaacagaggcagcagtaacctaactggactctagccttgcactgaatccttcttctagcctcagactacttcacattgcctttagagacatctcccacatacagtcataaccatgtcattccacaccctaaaaactccaacggttctcacacaaaatagagccagtccttagcatgtcagaacttccacacttgattcagccacctcatcagagtcatatccacaccctctttgacctgtgatcacacaagtgaattagccattcccctaaaatgacttaattacaaaccatatcccaccacttatgagactgtgcacagtctctaccagattttcagactttctttaagaaagttatatcttaatcatatatgaataccctcatcttcaccaccccatgcctagcagaaggcctagcatgcataggatctttttagctataactaaaggactgaattgaactcaactggattgacggatgaacaatccttactcaaaagatattgaatgttcagtatttttttaatggaagtaatttatgctggtgcagaggtctctttatgacaagagcccatctgagattttgtaggaacacttagaaaaggatagaagtcttgttcattacagaaactgataacacaaactagttagttataactagaggtggtgacttacacctatagccctagcactttgggaggccaaggcggtcgatcacctgaggtcaggagtttgagaccagcccagccaacatggtgaaaccctgtctctagtaaaacaaaaacaaaaacaaaacaaaacaaaacaaaccttgaaattaaagataaatgtgctagaactagtcatcaacatatagtccaaaacaacaactaattctgctctctcaattttcaaactataaagaaactggactaccttctagaaacttccaatcccacataaattcaagccctaatctcttacctggactgtggcagtatactacctcttaactgatccccttccttcttctttgtactctccaaaatattttcagtgccccagtcagagtgatcctgttaaaacattagccagatcttgccccactctcttccagtctaaacttcctaatagcttcccattacactcagagtaataaacaaaaaattttttttaataatcaaccagaacctaaatgacttgattctcactacctcttaaacttcatctcctactaccttaactttcatttactgtgttccaatcatattgacctctttgctgttccctgaaaaatcacccacttccctacctcagcctctttgatttttgttgttttctctgcttggtacgttctcttctcagatatacacacaaccacttccttacttccttttgccatctaaaatttcgactcctcctgccacagtagttaataatgcccttttctgctttattttggtctcttggcacttaatgctatctggcagggtatagattttactcttatgcattgtctgcctcaccaatggagagtaagctccatgtggaaatgaatttttgtcatttttgtttattaatgatttcctgaaacctaggacagaacttaaggaatagcagggaattgattatgaagtcaataatgagcaaataagaaattccatggagaagaatttgctttttggttcactacatgacatagaatgagacagatatgacaacatggtttaaaatgtttaaaaactgagagggttaaaacaatagaatttcttgatggaaattgttatggactgaatgtttgtcccaccccacctccaaattcatgcattaaagcctagctctgtatttggagataaggcctttatggaggtaattaaggttaaatgaggtcataagggtagggacctgatctgctaggattagtcctcataagcagaaatgccggagagctcactggctccctgccatgtgaggacacagcaagaaggtggccatctgcacataagggagagagccctcaccaggaaccagattggatggcaccttgatgttggactttccagtctccagaactagaagaaataaatttccgttaagacacccaggttgtggtatcttgttacagcacctgaaggggactaagatagaaatgtaccttaaaactaatctaacctaagtctcttacttaaaggataagaaaactgaagccagagaagttaagtggctttctaaaggtcacaaagtcagtatataccagaactaaacccattaaccacgtggcagttcagtgctttctctacttactatgctgactcttataccactctatgtagtatatgattaacataaggcagacattcttaaaccttattctcatggaactctgttcttccaaaggctgtagcaggcattttgctattaaaagttaagggtgatggtcttttcacaatatcttatgggggtatttaactgatttttttcactacagttttcactacagttttgtgttttttgccaataaatttttcttttcctataaatacaaaagaaatatatatatatatttatatatatatttataaatatatttatatatatatttataaatatatatatttatatatatttataaatatatatatatttatatatatttataaatatatatatttatatatatttataaatatatatatatttatatatatttataaatatatatatttatatatatatttatatatatatatctgaagaaattctgaaccataattctctaaaagtaattctgtcctttggagatgtagtaggatggatacattaaatatgggtaaattttctgctggtacaattgatcctaattcaaatgacagaattaatgctactcagaattttattgtggggatcagaaaagtcaaaaagagtcccttgacttttcagagccctgcttcctggacttgtttgaaaggcactgatgtaacagcatgacacagctgctcaaaagctattatgagcctaggctgaatcaatagaagataagtgtgcaaatcacagagatctcagtccctctggacttggcactattagaacatgtgcatgttattatatctatctgttgtctattcctggatcctatctttaaggtgttactgactggcattcatgggtaatgttaaaggaatagggaatagtttgggaagtgatgacttaggggaataagaagctgttttcagaactttgaagggctgaaataatgagggaatggatttgttttgtattgtttcatgtgcaaaatcaagctctgtgcacaaacactgcagagaagtagtttttcactcaatataagaccaattagagttgttatccctggaactgttccctagtaaaagtaataaaatgtgttgaaaagtactagaaatgtaccagccatcaatccagaatatacagaggaaatcctgtttaggaagtgatttaaaacagttgatctcaaaaggctattacaacacaaagattctgcccttctatgaatacaaagaactggattatttattataacgaatatgttacaagcaagtgcaatggctgggttttttttttttttttcatgccttgtaaaggggaagagggtaaaggtagaaaggccctggatgactaaaatgaatgtaaaaggaaaaagaaaaaaaatgaatgaagaggaaaaaggaaaagaaactgtaaatgcacaatttgcctaagtcttggcctgtttttcaatgagaaactctgcactgagataaattctattcctggtggctgcccatgcacacacgtggattaatgccttggctgtcttaaaaagtcagctacagtctctgagaccctcaatttttacttagctgctgagatattcatgaatgctatataaaaggagaaagaaaaccattagaagaaatattttcaaggatgatatttcaaattattgcttatttaaataaatattgctaccttacattaaagagataataagatactaaaagcttgaaaattttttttgattctaagagcaggtagaacatacttatccttaaataacaccttttccttttaataacatctaagcaatgagatttttacctttttttcttggtggtttcttctttagtcatttgtttctttctttaatgagtccttcctaatgatgttttatttttcacacttttatctgttttctctttttattaatgcttatagtattcatttttatttttgtagtatattttattctttttctcttttgaaaagtcatacttgaataaagtacatgtctcaaaaaaagacaaggacttttgcattttatattgattccttaattttaaaatttttaggttaagaataattctgtactatccataagtattgctttatgatgactatgcttaagttgttggtatatgttataatatagcatttcaaccccaaatacagatttctgttctgtactcttgggaatttatggaggaggagaagacaaaatttaccttcttcaagtctaaaaattatcacatttgggacacataaatccccatgtatctctttaaggacagcatattatttttaaaattaaaatataaatgtctaaagtagagaaaaaataagttcaccttgtccttatatggaaattaaagatggttgcttaaagaataatttagaatggcaaatgtctgaaggtttgctgtaaattccctgagatcttatatgatgttcacaccgactcagacacatacaaatgtcatctctacagaacggccctgaagagagcaatcctgggagcccggttcccctgttgaggcccctacttgggtcagccctatagggcagcagcttgtacactgggccctgctccccttccctctcctactgacttcaattccattgttttttcaagacctttctaagtggcaggaataaaactgatgatttaatctataccaagacattaatgattaatagtggccccatatattttcccttacatttaatgtttgtattataagggctttttatgccttagctgaaagtggtggtaggaattttaggcccacatcatacacacatctgcaaataaccaatctttttctcatagctataattatgcattggcattttatttacttcctgcaatttctctaagtgcatcattttgttctatatatagtattttaaataatacatctttagcctgatgtatttttgaaatatttgtggatgctaatcctatctctgtcacagagcttatttatacacacacatctttctcctcctgccttaaaccccttggtttattcttcccttgttccagtttactctcctatggaactttttaccatttgatgagatatttttaaggaatttgcagataataggagcttccagaataccttcacctgactcatgcttcggcataaagtccccatattatcccaaaactcatctacatgtttagttttcaattttcttatagccttttgattacagtgccactgaaaatatgtcatatttattgctttatccactgctttctgaacatagacagagacactgtaatatttttctaatactttggaataaaaagaagatagattatttgttgaataaatatgtaaatactaaaacacaagttactttcttgtcatcatgctatagtcttcatatgctttacacagagtatgatttggggtaaaccctagtaaagctgaggaacatataaaatgttcaggaatcacattctggaataatcatttaatgtttatgccatgctaaaagagttgggactattatctgtggaattaaaatttggagaaaagaaatggtaagattagcccactgattgataagccagaggtagcacctgtagtttcatggaggccacagctcagtgatacctcggtccctgaactggaaaataaagctaagcttccatttgcagatgttccagaaaaaaataaattttatatttgtgtttttactgtatttttggtagagacggggtttcaccatgttggccaggctggtcttgaactcctgacctcataatctgcctgccttggtctcccaaagtgctgggattacaggcctgagccaccgcgcccggcctggaaagaaagaaattttatgaaatcaaaggagctgctatatctttttcttttgtaacaaacataggaattttcttactggaacaaacccatagttgacctcttatagtactctatgtgtggaagggagaaaacattggtacttctacaaatgggtttcaccaccttttataataaaaacagaagatattcacaaaaatagctaaaaataaggctagcatgagaaatacacaaattactctttttctattatgaaattagcatgcaatctttttttttgtaagcaatccaaccatttcaaagagggtgtaccctccagataatagtgaataaaaaattcagtgaaagaaagtaagcttatagctgctataattttcagaaccattatgcatcctcttgcagctggttttgttggtgctgctaagcgcatcctcctgggcccatccacttagtatttatgggcatcaactaaggattgaagacgggagattagaataaatgtaaatcttagtggatataagatttttgatgaaaatgtttaaacggtacttgtatgccacacaagaccaatggcaattttcatgttggtcgtaatgtttataaatttaggtatataaatgaaggagaaacgtagagtagaagaaaaaaagatctctgtctttacatataaaagggctgaaacaaataattactctttatgctttgtcagatggtttatagtttattatgatcaatgtaatctcattttttcaagctgttttttagcaatcccgaagtgcaggaagatacacgctgttgcaaaactgttaaatgactgaatcaggactccaagccatgttttctgacttcaagacctgtatttaaattcctatagtattcttggaaaatactagactcagggatgttttcacagagtaatatgttttgaaaaatgtgtctgcgaaactgccttaaaacttgctatctcctgcaagtcatctggagttcaccagaagtctaccttttcaactagtttccttatataggaattttaaaaagtgagcagaaaagcatcacactttacttttgagaaatgtgaggcctccttgaaagcataatctattcccttttaacaaatacatagctcacagtaatgcagagtatgagactaggtagagtgattttagatgtagttatttttcctatttccttatgccacaaaatcattttttcacataccttgtgtaattcctgtgaatgattttcaagggatcttttggcatgtacaattatttatcatcaaatatttgtaaatgaaagttctagaggatgagacagaatatagacagctaatcttacgactgctctgaatgacaggcacagaggcaacacagacatttctgaaggagcaaaatgtcagtctgcaaaattgcctttcctagtttgatattggtcctcactgctcagaaatgaaaacggaaaacattcacgaggcattctagtataattgccagtggctgcttcactatatacagttaattagtatatgcatccatacttttaaaaagcaatacttttacattaacaaaccaattgttaatttaaaaattaacaggttttttttaaagttttaatattataagaatatttctgaggtcagtatttatacctctacagatctacatctagccacagaaaatccaaaatataatttactttggaaataaagtttcccatctgctggtccttaagagtaattgctggtttcactttgaattatcaaaatgacattcaggaccaaaaaataagaggcatgaaactactttcattgctactgtcagcaagtgaatgattcactttgaatttgcctgaagttgtcttacagaacacctgtccaagctcattccggttccccttttgacgcttttcttcactcctctcctagcaaataaatagggtttcttagtctaacacaaggaatagaagtataagaagtggggtctgctagtaataaggcttcaggtatgtgccttaggaagtgttttgtttgtttgttgaatgtgaaagacttagccaggaagggagaataccatttgcatgtataattttccaggttctgtttaaaacaggtattcttttttctacttccaagtgaggagacaggttcctctgaatagagaaatcctacactctgcttaatatcactttctgggacaaatttggttcttatagttctccagtggttacagaatatcaaatgcagcaaggaccctggagcttcagtaactattggtaacttattagttgcctcttttgccaagataatggcaaaaaggaaataatgaaaatgacatatttttatatttctgtatggcagtgctgatattttcttagatcatttttctaatattagaggagctctttatgttgccttatgactgctgacatttcatttacttaataaaatcaagttagcagtagactgttgtagaaaggtagctggacactaagtagaagaactgggctcaagtctcagatttgtcccttttgcctgtggtaatggcaaataagtcacctaactccctggggcttacactgctcacccttgagaaaaagagattggacttgcagcttttacagtggcagtggacatggctagagcttggatagtgctgacggggttcaggaaatactaaggaggatgaagctttgcagatggtaaaattattaatctatgcaatcttcagttatggcatcacctgaagactctcagaatctccagttctatacttaatgaatgactttgaagaggaggatctatcaaaagactggatccctctgcatattgtttacaatcaggttagaacttagattaaatctcaaggaaaacaagactcctaaaagcttactagtcaaggaagcctttcatgcacctgatagaatcctccattcaggccgggcgcggtggctcacgccggtaatcccagcactttgggaggctgaggcgggcggatcacgaggtcaggagatcgagaccatcctggctaacacggtgaaaccccgtctctactacaaatacaaaaaattagctgggcgtggcggcgggcgcctgtagtcccagctactcgggaggctgaggcaggagaatggcgtgaacccaggaggcgaagcttgcagtgagcggagacagcgccactgcactccagcctgggcgacagagcaagattccgtttaaaaaaaaaaaaaaaaaatcctccatcaaagttggggtgactatgaagtagaatctctaaagggggccaggatgttgattttgttccagtgcgtgtctaatacccaatcagaagattatagacatctatctcaccatttgagtaaatgcaaaataaaaataaattactacgaaacatttgaaagttagtgaataaaataggttgaattcagtaagtgctaaggtcatttctaggttcaaatatttttgcaaaatcaggaaggtgcaaaggcaaagcacaagcgtgctaacagcaaatgtgaaaagtatgtcttgcagccaaggcattctatttgtattttgcctgtgtcttagtccattagggctgctacaacaaaataccttaaaatgggtaatttataaataatagaaatgtattgctcattgtttgggaggctgggaagtccaaaagcaaggtgccagcagattgggtgtctggtgggaagccactctctactttacagatagttccttcttgcagcatcctcacatagcggaagtggtaaagaagctctctcaggcctcttatataaaataagcactaatcgcattcttgagggtggaatcctaatgaccaaattacctctgaaaggtcccaacacttaataccattgcattaggggttcagtctcaatgtataaattttgaggggacacaaaaatttagaccacagcagcctgtttatgtcatttcctctgaaccataatcattgctccacccgctaattttactctctctctcctctgccttctcagctatctacaatcaggttgtatagtaactatttatgtgctaatcatctgtgattgtcaccttagggtataatcaagaaaatgatgcataatgttgggaaataatactgcagtttaaatcatatccatattatatttttaagcaaattaagaaatttgaaaccatgtaattagaagcagtatcttcttatctctaaatattcaaagtatggacagtgccaggtacattcacagccattctaatatttgccaaatgaagcaagcctttttcaaatgaaataacgtagttttcacttaaacaatccctagtgtgaaatcaagaaaataatgcataatgttggaaattaatactgaaatctaaattatatcaatattgtatgttttaggtaagttgggaattgtgtgcccatgtaattagcgagttcataaaattatattttaactgcttttccttcaaattgtaggcttttctgagagtttagttgctattgttgttttgtcttcattgttgtttgtgaatttgcaagcacattttaagttttccatttaagaataagttgtatagaaatttaatagacttactacaggtgtccatattacccaagcctctgggctgtttggttctctccaaatagaatgttgagatcaaaatcctttttggtgcttatattagttttctaggactgatgccacaaagtgccacaaactgggtgccttaaacaacagaagtttgtcacctcacagttctggaggccagaaatttgagatcaagatgaccacaagtttcgtttattgctatagacaaaatgtgtcatcccaaaatttgcatgttaaaatcttaacattcaatgtgatgatattaagaagttgggctttgggaggtgattaggtcttgagagtgaagccctcataaatgggattagtgcccttataaaagagaccccagagagttccttctcccctttttgccatgaaaagacacagcaagaaggctgctgtctgtgcaacagtaagcatgccttcaccagacactgaatttactagcagctgtaacttcaacttcccagcctccaaaactgtaagaaataaatttctatagtttgcaagccacccagtttatggtatctttctacagcaacatgaatggactaagacattcctcctgagactaagagaggatctgttccatgcctctctcctggctcctggtttgctgggagcccttagagttccttgatttgtagatgcatcacttcaatctctgcctttgtgttcacatggaattctctctttgtgcatgtctctgggtccagatatcccctttttataaggacagcagccatattggattatagctcaccctgaagggctcgtcctaactacatttgcaatgacctgatttccaaacaaggtcatattttgagatatttgggattagaacttcaacgtaaaaatttttggaagacactattcaacccataacaatgctcatttgttaagataaaaccaaacaaaaaagaacattttaaaacacaaagattatcttcatagccctctacaaactaaaaacatatatatatatatatatatatatatgtaacatataataacatataaaagcataaaaatatatacaggtttctcagacatacacattctcttaatattctgggctctggactaatatatatatatatatatatatatatatatatatatatatatatatatatatatatgagtttttttgagtgcaaagagcttgggtgagcagagtgggaaatgagatgaaagaggtaaaagggtcttggttttaggaggatgggaaaccactgaaggttttccagtaattgaaggttttccagtagacatttgacatcatcggatttgtgtttttttatatatataaatatatatgctgattgcaatgttagaactgataaaagccaggcttaagtgattggcagactgtggtagaagacagctgggagctggcagctggactgtgctgcagtggtggtggtggttgttgataaaaaccatcaccttcagtagctatgtgttgggtaaaatgaacacgatattgtgatgcagtggctgtgggaagagggcaggggaaacaccagggacgattcccactttcttatccacaatgccaagagagaaaacactggatacagaccagttttgtggagaaaaccatgattttatatttgcaaatataacactggagttggatgtggctttgtgagactccagtgcacatagcaagtaggcaattgtatgcttccatctggagctcaagaggaggtcttgatgagacataaattttgaggttgtctatgtacagttgatggaaacctgggtgtgggaaagttgtcaccttcagagagaaaatagaatgaaacaggaagagtggctaaaaataatctttaagacacttcaacatctagcttctaggcagaataacacacttcaaactcaggaagctctggactcaggaaagccaagagaagaggatggctcaggagggaagggggagctgagtgttgctgagaggcccaataagatgagagccaaaggagccagtgaactttgtaatatggagcttcttggtgccctaaaacttactatttggtagaataataggtgggaaagccagaacaaagtaggttgaagagggaccaggaaggacaaaaatggtgaaagcaagaatagggtaaataagcgaaccagctagaaaatataggaggctgtgataagagttggggatgcttgaattagagattttggagctggaaaaaagtgtaataacaatgacatatagtaaagatatacagatgaagatggattaagcagctgaagttaaaaaaagattattaaaaacaataagctacagactgggtgcagtggctcatgcctgtaatcccagcactttgggagtccaaggcatatggatcacctgaggtcaggagtttgagaccagcctagccaacatggtgaaaccccatctctactaaaaatacaaaaattagccaggtgtagtggtgcagggctgtagtcctagctacttggaaggctgaggcaggagaatcacctgaacccaggatggggaggttgcaatgagccaagatcgtgccaccgcactccacccttggtgatagagtgagactctgtctcaaaaagaaagaaaagaaaggccaggcacggtggctcatgcctgtaatccccacactttggaaggctgaggcgggtggatcatgaggtcaagaggtcgagaccatcctggccaacatggtgaaaccccgtctctactaaaaatacaaaaattagctggcgcatgcccagctactcgggaggctgaggcagaagaatcacttgaacccagaggtggaggttgcagtgagccaagattgcaccactgcactccagcctgggcgacacagtgagaaaatgcaatgagatacaaaattagaaatcatattctcagatgagtggcatgcatactctaggatgggcaggtcctcaccagacccaaagactctcaacagtgaggagggggtctgggaggttggagatgacagcaagatggagactgagaggatgatgtgccggatggcatgagcctcacaactgtgacctttatacaagggcttgaggagatcaggcatgactagaaacttaagcctcagttccacccacaaacctggactgctggggatggcagagagaggcagccaccctttgaaaagcctgcagaggaagcagcagcgtggggagtgcagttagtacagagtgggagggaagacttgcaagggagatatttgagagaactcttaagatttttggaatggatttcagaaagcactgtggaggcctggcacattggcacatgcctgtaatcacaacactttgggaggctgaggctggaggatcacttgaggccaggagttcaagaccagcctgggccacactgcaagacctccatctatacataaaatttaaaaattagccaggcatggtagcatgtaactgtagtccctgctactcatgaaactgaggtgggaggatatgtggagcccaggatttcaaggctgcagtgagctatgatcatgccactgaactccaggctggacaacaggccactatcctgtctcgaagaaggaaagaagggagggagggaggaagggagggaaaaagagagagagagagagaagacaagacaagacaagacagtagaaagatttcaagagttgttgggcatcagagaagtacagggctgatgatgggaatagtgatgcatatggtagagaatgaatacctgaatacctgcaggtgtgcgctttcacttcagtattacaccatgaaaatgggattgcaaagcatgtaaacatcagcactggtactgcagatggctggagaatgcatcccactcagctggggtggatgtggtcccaggagtcccaggcaatttggtatgatgtgggtgcttcagtatcagccaggtacagctcacaggatatgtctaaaggagcaactgaatttttcagacagatttgtagacccaattttgtaaatatcactttcatggaaaagtggggagaggtgacacaaagtcaaatcaaatattaattctgtttgaagcgattccaaaatagtcattgtataccacatggttagaatcattaattaatggcttaaattattcattatttttagctgtttttgtattctgtagttatagcctagagctgtactttaacaaaaagcaacaatatttacctatgtgaagtagttatgagtatgaggaggtaattttttaaggtgcttagaaaacaggtttgtaaaatagcagacttttaacaagcaaagaaaatcagtgctgagaaagctagttagtaacatctcattagtaagacttttttcattttataataattaattaggcagccacattaggcaataatgagagctagtaatcacttttttattatggaaattagactggactcattttaaaacaacacttaatgcatatgctgtaatgaatatggaaaagtataagttgcttaagcaaaatgtataagattttgtactcctcccacaaaaataagtgactaaagatgggttgaaaagcagagttacttttctcaacttgtggattgtggaagtacattctctttgtattcttgaaggactgagtttataaggtggactgattttgtattctttgggatagtattattctggacaggatgcatttcattttcttaatcctttgccactagaaatgcaacagaggttattaactcttgttatttgtgcagaatcttggatcacttaaattatttgctgcatatttaagagactcacaactaaatgtagagttttaaacatctactggagtatagattgctctcaagttgtcaatttgatgaatcctaaactgtcctagtcaaattttgcactcctctgaagaccttaaagaggtaacttttgtaagaagcagaatgtataactttaccttctgagaaattagacaattgcaatatgaccttttcaggcatagtggggtgtggcttgaatgcttgaatgtttgttcttaccacttattttccagataagctaacaaatacttagagaaatcaagatgctcaaccagagtcccacacagagaccatacttcagtgatgtttatgctctttgttgctcaaagtcatgccagaatatcttcactgttaatggcactgtaggtccttatcttcattccctaggccttacataccttctatatgcaaatgacatcaaaatttatctctcacaccatcctctttcctgagctgaagacttgtattttcaacttgctatttaatagctcccttcagaaacctcatcagcatctcgatactggcatggcctgacctgcctccaacccccctcatcatcttggtggatgcagcggtgacgcagccagttgctgatgcaaaaaatcccaaaaatcccaggaacctctttccgttctcttactcccacacctcatggagaccctcatgaatcatccagtaggatatactttttttttctttttcttttttttttttttttttttttgagacagtgtcttgctctgtcagccaggctggagtaaagtggtgtgatcttggctcactgcaacctctgcctcctgggctcaagaaattctcctgcctcagcctcccaagtagctgggattacaggcatgcatcaccatgcctggctaatttttttatatttttagtagggaaggggtttcaccatgttggccaggctggtctcaaactcctgacctcaagtgatctgcccgcctcggcctcccaaagtgctgggattacaggcgtgagccaccacgcccggcccaatagagtacactttaacattagaaacgaagtcctatcgttgccaactttaagacctaccctatatctaacttctcaccactatccaaaccacaaacaacctttcacttcctccactgcagtcacttcttggctggtcgttctatttactacatggcagaatattttattttctaaaatacaaatccagtctccccactgctcacaattctctggcatcttcttatcactcttaggatgaaactgtgactcctccccagtcttacccatgactcctctgctttgcccagacatccagccacacaggtgaatgtactgacagcttccaagctcttacctttgccccttgtgatggttaatattgagtgtcaacttgattggattgaagtatgcaaagtattgcttctgggtgtttctagaagagattaacatttgagtcagtggactgggagcgaaagtctcccagtgtgtgggcaccatctattggctgctagcagggcaagaaaaagcaggcggaaggaggtggaaggtgttgacttgctgagtcttctggtcttcatctttctcccatgctggatgcttcctgcccttgaacatcagattccaagttcttcagcttttgcactcttggacttacatcagcagtttgccaggctctcgggcctttagccacaaaccgaaggctgttctgtcggctttcctacttttgaagtctgggactgggactgagccactattggcttccttgctcctcagcttgcagaaagcctattgtgggacttcaccttgtgattgtgtgagtcaatactccttaataaactctttttcatatatacatatatcctattagttctgtccctctagagaaccctgacctactatacccttatttctgcctagaaggttctttccccaaatctttagttgtcatgtctgtttatcattcagcttcccgcttaaatgtcacctactaggaagagccttcctcaactgtcctgtgtcagaaagtccaccacccaccccagcacccctccagccctgctcactttcttcaacatatatatcactatccgaaagtattgattcatttccctatttattttctgtctttctttccaaaatgtgggcaggaggagcttggctttgcttactactgtctccttaatgcctgcatagaggaacagagttcagtaagtatttgtcgaatgaagaatagtgatacacttcttcctataatttgatttttaacctctggagattatcaattggctcacctccctgctaaaaggaaacctgatttattgtaataaccctacgttctctacgctactctatccccaaaactctgctaatcatattatttccatgttgttataattaatgttacttttatcccattttataacttgaatttcacagttgtttagatgctattctatgtttgcatggattcaatattcgccatcatttctctactgtgtcttccttatccatctcatggttgactgtagtttactatttaataactttttaaagaaatgctcgtgagagttaaagtccgagaacacttgtttgttgggtaatataaaccctccacctatgtggcagtttttatgggcatggtcattattggatcataacttccacctctgagcattttgcagacgttccacatctcctaggactgatctctggatacccacagaaatatttgctcttctttttcgataaatttcctgtaatattctcatttttaccaaagcctacaagtattccttggaagtttctactttcagcaaattcagttctctcttgtaaagttacttttctattacattattatttttaaaatgtcatctgttatttctagttgcacgttttgtctttcattatttttgtctctttactaatattaatcaactttttgtccttttccattttattttgttcatttttttctcatttgtcctagatgcctctgatgacattttcagtaaagccagtttctcctcttgctgattttcatttctgtgttgattttttcccttccatttctttccaaaatctatcagttcacttttcaactacctccattgtcctataatatcttacctgggagcttctagaccttctttgggctcctgttacttacatgacatatagtcatacattttatctgatttgtcatacctcttgtttgatatatatagtctttctctggccttctgtttgctgtctctctctctctttttttttttttttttcatttaggtagtatctttgcataggtctcatgctttctttttggtatttactcatcactgaataagggaactaattcggttatgaagataaaaaccagctatttgcactaggagagtataaggaagggacaaggatagtaacccaggacaatgcaacacagtttgcactgtactctgatgtcttcagcatactcatgcatcctctgccccagacataaatgtgccctcagctagcaggaaaactccctgtgaagctgtgagatgcccattgtgggtttcctctgtactcattgagctcttacttctcttcagttggcaaaaagaggtaacttcaggaacatgcgccatacacatgttcttctctacgtggccacatggacaagtcaggcttcagcgaaaggacacggatgtcatttcctcatcaagtctcctcttccccactgctccgtgttgcctgccattccgggcatagagcggcttggcccagaaaccacacaaatgggccttgttgttccaaggtgggtctcctagtgtttcccctaagggcaccacctaattagaagcattctttgcttggtcagctctgcctaagttctacaggggatgtggtcctctctctgtgccccttcacctgcagccttgctctcagaatctttctccacgtattatagtatattattcaggcatttccaaataaagacagagtttcttttttaataacaactttatgaagatacaattcaccactgttaattataccatttaatgctgttagtatagtcacggtgttgtgcaactatcaccacaatcaattttagaatcgtttcagtaaccgaaaagaaaccccatacccatgaataaccattttctatctccgccaacttctcagccctaagcaaccactttctgtatctatggatttacctatcttagactttgcatataaatggaatcattgcaatatgtggcattttgtgtcttgcttctttcacttagcataatgtttttgaagtcaatccacgttgtagtgtgtgtgtgtgtgtgtatatatatatatcttagtacttcattccttttattgctgaataatatatctcattgtatgactatgccacgttttatttataatttatcaactgaaggacaattgagtttacatttttgcctgttattaataatgcttctatgaccattcatctacaagtatttctgtagatatatgcttttaattttcttcatatatattgatgagttgaattgctgggctatattgtaacagtatgtgtagcctttgaggaactgccagactgtttttcaaagcagctgcaccattttacatccccatcaacagtgtataaaggtttccatttcctcatattcttggcaacatatgttattgtccatcttttttattatggccatcctactccaggtgaagtaataattcagggttttgatgttaatttccctgatgactaatgatgggcatcttttcatgtgtttatcggccatttgtttatcttacttggagcaagtcttattttgattttttgcccacattttaattgaattattaatcttctttattaatgagttgtaagagttatttacatattctggttttatcaggtatatggttttcaaaaaatttatcatctgtgtgttgtctttttacattattaacagtatcttttgacgcccaaatattttaattttgataatattcaatttatttattttcttactttgttgcttgtgcttaagtatcatatctaagaaaccatttctaattcaaagacatgaagacttactacacctatgttttcatctaagaatttaatagttttagcagttatgttcatgtctttaatccacttgaattaattttgtatatggtgtgagataggggtcaaactttatacttttgcatgtgtataccaggtgtagcagcttcatttattgaaaaatactgctttttccccattgaattgtttggcactctggctgaaaatcagttgaccataactctgagagtatatttctatttaattgatctatatatctatttttatgccaataccacactgccttgattactatagctttgcagtttttgaaattggaaagtgtgagtcctccaactgtgtttttctattttaagatgcttttggctgttctgagtcccttgaattttcacatgaaatttaagatcagcttgtcaatttctacaaagaaatcaggtggggatttaatacaggttgcattaaatcagacctcaagttagggagaagtcccatataaacaatattaagtcttttgatctatgaatatgtgatgtgttttcattcattcagatttttgctttctttcaacaatgtttgacagtttttaaagtataggtttgtgccctttttgctatatttagtcctcagtattttattatctttgatgctgttgtaaatggaattttctcttagttttatatttagattatttattgcaagtgtatacaaataaaattggttattctatatggatcttttattctgcaactttgctaatttttagttataatagtttttagtggattccttatgatgttttatatacaagatcctgttatctttagataaataattttaattcttcttttataatctggatgtatttaatttatttttcttgcctaattgccatgactagaacctcctataaaattttaaattgaagtgataagcacatacatccttgtcttgttcctgattttagggggaaggtattcagtctttcaccattaagtatgatattagctgtggttattttctaggtgtccttcaccaggatgaagacatttccttctatttctaacttgttgagtgtttctatcattaaagggtgttgaatttagtcaaatgctttttctgtatttattgagatgttcatatggttttagttctattccatgaatatggtatattagagtcaccggttttcagatgttaaaccaatcttatacattcattttattcatgagatatgatccttttcatatattcctgggtttgatttgctagcatttcattgaagttttttataccacaattcataagagatttcagtatgatttttttctggtgatgtctttttctcgtttcagcatgagggtaataatagcctcatagaatgaatagggatacctccttttctatgttacgagtttgttttgcagaaatcaccagtgaagcttgtacttttctttatgggtagttttttttttaaaaacaattaattcaatcttatttgttaaaggccgttaatatattctatttctttctgggtcagttttggtagtttgtatttttttaggaatttgtcctttgcatcttgtttaatttgttggcatatattagttcatagtttcccttatcatcttttttatttctgtaaagttcgtagtaataccccatatttcatttttgattttagtagtttgagtcttttccattttgttttcttggtgagtctagttcacagtttgtccattttattgatcttttcaaagaattagttttgattatgttaactatctctgttattttctataatttattttgtatatctccactctagcttttattattttcttccctattcttgcctagcatttagtttgctcctctttttttaatgacttcagatgctgtttgcatgacatgtgtttttccatcctgtcactttcaatctatctggtttctttgaatctaaagtgtatctcctgtaaacagcaaatagttgaatcttgttttttattttatccagtctcacaatttctgccttttaattagattgtttaatctattcacttttaatgtttttattgacatatttgtacttatatttgccattttactttttgtttcctatgtctcatgtcttttgtttctcaattgttttattactgctttcactgcattaactaaatattttctcctgtttgtcttttcatttctaattttatttgtcagctttcgttggtttcaggtgttcaggtggtaaggagaagcagagaagacattgctcttccattttaaattagaagttatctgtctaaggtcttcaagggcaaatatttcataatacttttctacccccatagtagatatgtgtgaggttcatcacaaatcctcctctcccaaacatcttttcagtttggttcagtgactgagtcattaggtgctagtaaagaaatctgggttttaattctagctctgttattaactagttgaatgatcatggaatattcatataacctctcttggacttattttctgacatataaaatgagagggttgaatttgattttatttaatttcccttttagcactgatatgctaaatttccagtaatactgtgatcatatggatctaaatacataagcacataagccaggcagagttaggcattttgcttcttgcaataggcaatcttatctacaactgattttgaagcataggatttaactagatccacaatatagtaaaataattatttggcccaaactactcactggccagtagcccacagattatccccttatgtgtaagagaccatgatttgagaatagaaggaaatacagactttgaagtgattacaaatataagctagtccaagatgcctcatgagaataaaagctttatgtggagtcctatatctatgtccaataatttgtttaaaggtattttgttagcaaatccattatccattgactgtctacagtgtgcatacctctcaagagtggcttatgtactataacaaaaacacaggagacccgctctaattggcctcattttaaaatgaaagggagaataaacacagtggcacctttaattattaatgacaattgaaggaagccttagcacaaataatcccaaagacatttctatttggcttggaattttaatattgtttttgacagatctatttacctaattatattttatctaggatagtgtttaaatgaggttctgtttgctaagcacttaccaacagagcagtagaagacatggctacaaagtgtattgcttatagcaggaagctggtccaggatttattaaaaaaaaaaaacataaaacatgttttgtgaattatccataacaaggaataccctcatgcagataatcaacaattgaatacgcataaaacacagatgacaaaaaaacaaggaagcttctctataaccaagcacagctgggcaaggatgcacagagatgctgcaggggattcatggggtgactggagtcgagacaattagtctgtaaaagcttcgtgctgatgccctcctgcagcacatttccttaacatctttaaaaatgcaccagtccagctgtttcatggagcatctcaggcttttaagacctccgtttttttgtctcattcattctctttattaccattaacaaagagtgggtcttagacagctgaatgttctacttacttaatgatcaagatcgtggagatagtttcaataatctaatggataaagaatccagaaatatcttaaagtttgtgttttcaggcttattctctgagtgtcagtccctctcaactagttcttacttagtcccaccctgataccatgctgtcaaattacttgctattaacttacaaatcacattctcctgttataattctcgttgagggaacatcagtgtcccccctaatttcacctacatggttacctttgtaaaaaaaactatctgagacacctgtgcttattcatgatactgtattatattgaatggttttagactttagtcttcctttagaaaaaattctcaacttaactttgtttcatgaatacctgtttacttctatatgttgcattttagattcccttcagaccaactaaatatgttcttattgaccatcaatgaaaaaaaaaggtatctaaaaatgggaagtatttaagacttgtactcagtcaaaccctacgtttgagggtttttaagctgtttgataacaaccatcctctgccagcatccccccaatatgtttcataaaatattacttacatggaattttaacagatattttgtcaaaataagttttagaaacacaaagtaaaataatttttttttacactttaggactcttggagctctggatagtataatgtgccttatgaatcttgaatagaggaatgtaatgtaatgcaatctcccaacatttttaatgcatatccattctgagaaatatcttttgtgtgatgttccagcataaattactaaaggtgaagagatacatatttgagctataaagactagatctttttttcctactttcattcccaaataatacaaaaactattcatcaaaatgttaacactaaaacaaatagattaaaaatttcaacataaactgaagaatatggtaatgacaccaagaagttatttaaatcttcagtatcaataattacccttcaaataacactatgttgctactctgagtacttttatattcgtgtctctatcgtggtaatacagccgtaacttgtcttcccacttagaccgaagaaaattaaactaaaaatgcgttagtagggcatatagataatgaataatgtgctcctttagaaaatattaaccatacttctgccaaatacattgttgtcacagtgcacggagaacttcatttcacaaggctttttgcaagattgatggtgtaacttgagtaggtttggcaaaaggagcatgcaaatttcagcaatataattacatcattttcccttatggataccacccaaccgagaaatagatccaatagtcagatgagaaattaaatacagtaccagctttattagtaggtcaattagcatagttttggctacaaggaacaaaaatcaccaaataaaactgacttaaaagtagggtaatttctcatctcaaataaaaagctgttcagaggtaagtttactccaggatgtcagggctctagagatacaactcagtgattctctgggtttttgtcctgtacgtaatggcttcatccttgcactggaagtgagatggctgtgttagctacagatgtaacatctagacatataaacattcagaggaaaaacagaaactccactcttacttaggagtaagaaaaccaaacctttccagtaaggctttcatgaatttccctctcattttattggctagaattgggtcacacactcattcctaaatcctgacaagggaaatggatttaccatgattgatttagacaaatcagactatcctggatgtagggataaaggtatcctctcttcagctactttagaggagtcgattttgggggaaggaaaaaggagagcagagaatgaacactgaacatagtaactgagagtgttcacactattacccagcacacagggtctctgatgaagtctaaccgtgttttcctccttgtttccctccatattgaatttatccaactagatcgcaggcaaagaagatggatgatggtaagcttgctgaagctcaccttctctcacctgcctacacatgcaaaagcagccagtgtaaaaccccaggccttcccataacccatgtgctacacagcaagagaaagaaggagagtttcaggcatgaaaataataagagaattctgcccttatctcagcagttctgtgagtcacttctcctcagggaagagcaattagaaggatagaaagaatggtagacatttacttcccagaatatattagcagagtttcctttttcttggtggaaactccaggaggaaagatgaagtttttctttttgggtaaaagatgaggtgaggggtagaggggaaagcacactagttttaggtgccatcaataatcctgtaggcattcatcctgcaatcatgtagtaaatcataacatttgtcatgcagggaggtaggtactggatgagcattgggaagaagacgtggtcccagctatggaactccaaattctgtgtctccaatgtgatatgggaagtaattataatatgtaagctatttgttatgtctacaaagcattgtaaaaatgtatattaaatttaaaaaaaaggcaagaaatctttttcctgttcagtagttccaaaaagactttaccaaataaatgaaattagtgcagaatttaggaagatgtatagattgtcattagtcaggctacaggaaggaaatcatttcaggcaaagacaagatcctgagtgaaggcccagatgcatgagagcagaaattgtcttccagaagctatgggtaaacctctatggttcaaatatggtgtctagagtgagacacattgctaaggcagaaaatcagcctgaaaggaagattgggtcaagttatcaagtttttttcacaccactcaatattatagttgaggcagaatactattttcctctctccttcctgatctttgccgttaaatctttcagtggaaattatacacagtatgatatatgcagtaagggaaatacttaacaggcctctgtcatgggcatttgtggatgagtacaaaagaaatagaagatacaaattcttcacacaataaatatatagtatgtgtcaaaattaaataagataataatataagacaatgaggcaatagtgccattgcttgtggcaatttttaaactccattttttgagccagtagtgccaaattttgtctatactcccaagtgtcagattcaatcattctgtcatcacatatttattatatgctgtgtgctggataaaaatcttcatcgttgagggaagatttgatttggggatccctcccaaagttatttgtatcaaagtcagctgaataaggtggctgatcatgataaggaatgccattatagactaagacccaactgcaaggaggaaatgagattttttttttgacctgtacactgtgaagcataaaataagaaccataaacttaaggccatttaaaaagagaattatagaaaagcattttaagcaaaggcagctcactttaaaaaaaaaaaagtgactaacttcccacaaagactcctttgaaggacacgcctcatttgggtgtatagatctccctacgtttgttgccatgagccttagtctatcatcatcatacctcaacttagcaagttctatagcatatggaggagacaaaattgcttcagccatttagacaagactgaaatcattgtgggcttccgtgattggaaaaggtctttaaaaagctttgaacccagcatggaccttcactgcaaatacagtcatgtgctgcataatgatgtttcataatgatggaccaataaatggtagtatcaaaatattataatgccatattactactgtactttttctatgtttagatatacacatagttactattttaccattgtgtcacatttgcctgcagtattcagtacagtaacatactgtacaggtttgcagcctagaagcaatgggctgtaccagatagcctaggtgagtagtaggctatcccatctaggtttgtgtaagtatgctctatgatggtcatacaatgacaacatcaactaacaacacatatctcagaacatatccccattgggaagtgacaaagtgactctactggaaaacaaaatatttcgtacaaagcctgggatgtgtgctctgtttattatcacctcaaagaagacttacaaattgggagaactaagatttgtaagagttctcaaacatagagagaatattatgtatcattattatatatcatgcatacattcgtgtatatttacttcttagaaacgtgtatcatgtatatgcatgttaaataggtatgtagtctttggcaacttctatgaagttttttttttttttttaatttttttttttttttattgatcattcttgggtgtttttcgcagagggggatttggcagggtcataggacaatagtggagggaaggtcggcagataaacaagtgaacaaaggtctctggttttcctaggcagagcaccctgcggccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcatatgtttcagagagcacagggttgggggtaaggtcaccaatcaacaggatcccaagacagaagaatttatcttagtacagaacaaaatgaaaagtctcccatgtctacttctttctacacagacacggcaaccatccgatttctcaatcttttccccacccttcccccctttccattccacaaaaccgccattgtcatcatggcctgttctcaatgacctgctgggcacacctcccagacggggggggcggccgggcagaggggctcctcacttcccagtaggggcagccgggcagaggcgcccctcacctcctggacggggcggctggccgggcggggggctgacacccccacctccctcccggacggggtggctgccgggcggagacgctcctcacttcccggacagggtggctgccgggcggaggggctcctcacttctcagacggggcagttgccgggcggagggtctcctcacttctcagacggggcggccgggcagagacgctcctcacctcccagacggggtcgcggccgggcagaggcgctcctcacatcccagacggggcggcggggcagaggtgctccccacatctcagacgatgggcggccgggaagagacgctcctcacttcccagatgggatggcggccgggcagagacgctcctcactttccagactgggcagccaggcagaggggctcctcacatcccagacgatgggcggccaggcagagacactcctcacctcccagacggggtggcggccgggcagaggctgcaatctcggcactttgggaggccaaggcaggcggctgggaggtggaagttgtagcgagccgagatcaggccactgcactccagcctgggcaccattgagcactgagtgaaccagactccgtctgcaatcctggcacctcgggaggccgaggctggcggatcactcgcggttacgagctggagaccagcccggccaacacagcgaaaccccgtctccaccaaaaaagtacgaaaaccagtcaggcgtggcggcgcgcacctgcaatcgcaggcactcggcaggctgaggcaggagaatcaggcagggaggttgcagtgagccgagatggcagcagtacagtccagcttccgctcggcatcagagggagactgtggaaaggggagagggagagggagggggagggggagagggagagggagagggagagggagagggagagctctatgaagttttatcaacctgcacttttaaggtaacgtgtaggttaattttcacttctcaaaaccctcacttcagatagaaaaaataacttcggaaacagcaataataatagtaataattataataaatagtctaaataattgaaatgaaacctaataaacagacaaaggaaatgatacaaatggaataataatgaacaagagaaaaatttacgattgtgaaaattagattgtaaaatggctttagaggaaaagtactgtaattcacattcctacagttatttgagagaaagggaccaaaccagtttaaaaatgtttttactgagaatttaaaaacaccctttagaaatagaaattcagtttctgactttatttagcaaaaattaaccagcaaaaaccttatgccccccaaaatgtgacctctttctctgtggatagtccagtgtttttcagcctagagcctaattctgctcttgggggacagggtccatgaagcgcaaccctgtgttttgtattcatagaaatgcagccagcaaacttgggtattggatgaactgggcattgtgggtcactctgcccgtggacctgctggtggcaccgcagggaaaaggttagaaactgcatgttctctgccaggcagaggctctactcatgttcttctagggagtcttgccttgtcatttctaccagtcatagactgggagatttgctgaccttagagatagtaatatatttcaaacctcaagaggcaagaatgatatgaaacaaaggatatccctggatttcctctggggctgcgaaagggagtctccacctggctctggaaggctatgtcttgtttccatccactccatttaactcccacttcttggcctgctttgagactgtcagctgggggccaattactgccatttagagaagtggatgctttaatgtgaatacttgtctgcaggaaccacacagagacagctgccttatctcacaagaaccctgtgttgtttatactcagtaatctgccacagagctctctccacaatggggaaacgaatccaatttattctccctattgcctgcacttaatttctttgactcgtttacatgtctgtctttttaagttgaagaaagaatacgaatgtaagttcctctgtggctaagagcatctttgactgtgttcttaacagtctaagacaatggagcaatagtactattgcctgaggcaacccttctgagtttttcaatttattaccaaatttttagatgaattatgatctagtctagttccagatggtgcatctagatctttataaataccagaagcacttacttgaaaagctgccagatctataaagggatctactactatgacttggagttttttcatacattattgtctgttttcataaattgataattaataggttctctaaaagccaagctgttcatggtttaaaaacagctgttagccatgaaaactgtggtgacatctacttaccaaggtatttccagagagacatgtagaatcacactggaaattctgtaccactccctggtgctcttctgggcagggagagtttactccacaatgccacaaaatcttatcagattactctccttttgaaaccttccaaagacttcacactccatctaagataaaactcagaggccctgagcatgaccttcaaggtgctcacccactctcttgcttcagtttttgtttttttgtttgtttgttttatttttagacagggtctcactttgtcacccagactggagtacagtggtgcgatctcggctcactgcaacctctgcctcccaggctcaagtgattctcctgcctcagcctcccgaatagctggggttataggcatgcaccatgacacctggctaatttttgtatttttagtagagatggcgtttcaccatgttggccaggctggtctcaaactcctgacctcaaatgatccacccagcttatcttcccacagtgctgggattacaggcatgagccacccagcccagccctgcttcagtttttaacctcaccacctcccacaccaagctatgtccacagttgcctttttctctgttcttagaaccctacattgatgagcatcagggcacttgtctcacctcataatccagttatcctctgaggcagaatagaaatccagacctggaatctcctcttgtttctgctttccaacagcttcctctcaatcaaaatgacaaatgattcaatatcatttttttttttttgagacggagcctgagttttgttgcccaggctagagtgcaatggtgtgatcttggctcactgcaacctccaccacccaggttcaagcgattctcctgcctcagccttctgagtagctgggattaccagcctggcctcgaactcctcacctcaggtcatctgccctcccaaagtgctgggattataggtgtgagccacaatgccaagcccagtatcattcttgattaattagttgcaacttaaaggagtgaattttctaaatataagattatatcatctaaaaacaaggataatttgatttctccccttccaatttggatgagctttatttctttatcttgtctgactgctctgactaggactttaagtaccatgttgaataaaagtggagaaagtgggcatccttgtcttgttccagatcttagaggaaaggcattcagtttttccctgctcagtatgacattacctatgggtttgtcagatacagcctttattgtgttgagctatgttcttttgtaccctattggttgagagttttttatcatgaaggaatgctgggttttatcaaatgctttttctagcctctattaaaatgatgatatggtttttgtccttcattctattgatgtgatgtatcacttttactgatttgcatttgttgagccatccttgcatccctgggatgaatccacttgatcgggatgactgatctttttaatgtgttgttgcatttgatttgctagtattttcttgagaatcaaatcaaaatggattgagggcttcaatgtaagacctgaaactatgaaactagtaaaagaaaacattgggggaaatgcttcaggacattggtctggacaaaggtttcttgagtaagaccttaaaagcacaagaaaccaaagcaaaaatggagaagtaggattacatcaagctaaaaatctccacacagcaagggagacaatcaacaaagtgaagtgacaacttacagaatgggagaaaatatttgcaaactattcagctgagaaggattagtaaccagaacatataaagaacacaactcaatagcaaaaagcaactaataattgtatttaaaagtagggaaaatagctgagtagacatttttcacatacatatgcccaacaggtatgtgaaaaaatgctcaacatcactaataatcagagcaagacaaataaaaaaccataataagtatcatctcacccaagttaaaatggcttttatcaaaaagataaaataataacagatggtagtgaggatgcagagaaaggggaacacttgcccactggtggtgggaatgtgaattagtatagtcattatggaaaacagcataaaggtttctcagaaaactaaaaatagagctattaatactatatgatccagtaatcccactgctgaatatatataaaaaagaatgaaaatcagtatttcaaaaaggtatctgcactcccaggtttattgcagcactatttgcagtagccaagatgtggaagcagccttagtgtctacctacatatgaatggataaagaaaatgtggtacatatacaaaatggaatattattcaaccataaaaagaatgaaattctgtcatttacaacaatatggttggaactggaggtcattatattaagtgaaataagccaggcaccaaaaggcaaatattgcatattctcactcatgagtgggagctaaaacaattgatctcatggaggtagagagtagaatgatggttaccagactttaggaagggtagtggggaaggaggaataaagaggtgatggttaatgagtacaaaactacagttaggtagaaggaatgagatgtagtgtttggtagcacaatagggtgactatagttaacaataatttattgtatatttcaaaataacttgaagagtgggattgaaatgttcctaacacaaattatatatggctgggcattgtggctcaagcctgtaatcctagcactttgggaggctcaggtgggagaatcgcttgaacccaggagtttgagaccatagtgggcaccataatgagacccctatctctacaaaagaataaaaagttttaaaaaattagcttggcatgagggtgtatgcctgtggtcccagctacttgagaggctgagctgggaggatcacctgaacccaggagattgaggcttcagtgagccatggttacttcactgtactcgagcctggatgacagagcaggtccttgactcaaaaaaaaaaaaaaaaaaaaaaacgaaaacaaaaaaaagaagaggaggaaatgatatatgtttaagaacatggagatccccattaacctgatttttatcattacaccttgcatgctgtatcaaaatattgcatgtgtcccatatatatgttcaaatattatgtacccatagaaattaaaaataaaaaaaattaaagctaaattttaagttttcactgtgttctcagagcacgtagtcattctatccatctatccacccatccatcaatcgagtgcctagtacgtaaccttaaagtgattatatttcttagtaagcacctgctgtatactaaaggtaaaagttattggtctctgtgcatatgtggttgagtttagcagataaggcagaccaacaaacaaatcactatatgatgggggaatagatcaggttttctagaaacatgagtgagagcttctaatatgccctagttggtgatgtgagcgtcaggacagtttttctaagagttgttttgagttaagcattaaatcatgaataaaagatagtttgggttgccagatatttatcaggctttcattgatgcccccttaacatttgccagtcatatgggaagtactcaaaaaatgtttgagattcattctttagtgatatgttcactttcttttttaaaaaaaaaaaataaaaagtagtttgagacttctgtgattctctgtaaataaattttgacttgacatgtctgggaccttggcactgactctcctgggatacctcaattcccctcctttcccctttcctctctctatatatactatatatatgaagtcccattgtcctggcctctccatatggcctctttctgtaggatactggatgatattctgtacctctttgcaatttgttagctgagagccaggaaagtgaaagcaggaactgctgggacccataacatcgaggcccggaaagggcagcgtcacttctatagcattataatgatcaaagaaagtcacaggccagccaagattctggggaggagaaatcaattccatctctcatgtatgtagtggaaaagggattgctggtggctatctttggcaactatctactgcattccctcctcctcaaattaccttattctttctatcctcccaaagactaccatatgtatatttgcactcattctctagatttgacataaattggttgacactaatgacacttccctgtgtctaacccttgtccccatcatccaattctttctgcccttacctggcatctgtaattaatttctttgcctccaatgttacttctctgtttggtagtgcaattgaagaccacataaaaatgctgctagaatgcatctcctttgttagcagatttagtattctaatgtgaaattccttctcatcctttaaaacccagttaaatctgacttctataaagtccttattgactatcccaaagaagaggggatttctctttctaaaatttgtagtaatgtgtttctggaatgtattctagttttgactatggttaggaatacacatgctttacctttctaataattttgaaaactcaaaggcaggcagtaggatatactcattttttaaattttctaaagcaccaagatgagcccattacatagaataagttgagtttttgttgagttgtcagggatctgggaagaatggtttggcttttaggagaggttctcagccaaccaggaaggaaaaaaaaaatgattcagtgattagtgacaacagctttacttctagaatcctcccacctactactggcagcacgagcaggcagcttgccttcctgggacgaacctagatgaggtacaatgtggctggaaagctctctaatactgatctgacatggcatatttcagattaatctgttttctctccttgtttccagtttcagcacatactaatgccatcttgaatcttacttttcctccctggccctcagcttccccatctgtaaataacaaaggctactatttactaagaacctgcatcagtgccagacacagtgctgggcactagtgctaatcctcacaataatagtgaaaggtgcattttttttatttcctccttttaaatgaatatcagatatggaaaggaaaacaacttgcccaagccctctcagcacaactggattgaaactcatcccccatgagtagcatcagggtcaggccagataagctgtaaattcccttagcctttactatgcatctccaccaggatgtaaaatacaatctgctgtttgtcttccaccttctcctagaccagcttttctgcgtcattatttttcttttttgtcttcagctgcagtttctcttatcagttattggctccacaactagcaagtttattttttgctccatattgtattctggtgtgttatgctacaatttgtatagggaatgagacacaatatggtttgctaatgagaaaatctacactgcagagacagaacctatttgttctcagttacttgaaacgtatgttagaatgtagaatctcttcttcattcccgtgtgaggtgctgaggaaggctggaggggttctgattcagtcacatttgattttggagtcaaggtcttggcttcaactcatattgagttttactggaaactgccagctttgttttgggtagacatttgtaaatgtgacagaacagatgactcatctcaagccagctctatgcttttattcaatgtgtgcttaaaaagagtaaacgtggatgttggaaagtattttcttgtaagtactttgtatggcagatgccaagtactgctaaacctaattatttaattcttcttcttaaatagatattatttagttttaatttttaaaaaccttcaactatataattgatatatatcatatatatagatatagatatatatcaataatataattttactttttagcacaccagaagcatattattttggaagatcataggactcagagctctggataggcaaagtagacttggatttacattctctgtgatcttaagaaatctactttctcccttattttcacttttctgtactaaaaaaaacagctgtactaacatgaataatatgtacctcacagggttcatgttgaggacaaaattattaatagataatatgtcaaagagcttgccatataatcagtaggttctttcctgccatggaaaaatttttttagtcagaataggtctcagccaacctctttcatgttccagaatttaatgcatacttgctgattcaatacaggtagaaagtttaatattaatttttattttgttggctttctaaaaaagcagtcttttcacattagaataagtgaatgaaagagatcactaaaatcaaaagttgttacaaatgttattttgattgctatgatttcaaatgcagttttatcttcttataaagttaaaatacccaatttcgtttttaatttatttggaaacaacaacacgactggttgaatactctgtctaaagtaatctctaacaaagaatgactgaagttctactctaccaatgaaaagcaagaaccggggttcctcctttctctttctgtggtatgggagctacatgaaggcagaataaaagagtcagactaggctgggaatcctgttcaagagaggcactcagttacagtgtacatgtcagaattgattgataaagttactaggaagtaggcatgtaaccttagttagtcttgttctccagttttcaataaaatgtggactatacctttgggggttgtgttcatttgtttgtttttaagacagagtcttgctctgtcacccaggctggagtgaagtggcacaatctcagctcactgcaacctccacctcctgggttcaagcaattctcctgcctcagcctcccaagtagctgggactataggcacgtgcaaccacgctcagctgattttttgtatttttagtggagacgcagagtttcaccaagttgcccaggctggtctcgaactcctgagctcaggcaatccacccatctaggcctcacaaagtgctaggattacaggcatgagccaccatgcccagcctactacagtatttttaaagaagagcagtttcacagtgtcaccaaatcatggctttcagatccagagttacaaattgcctcccaactcagcagttcttgaaaatataatattaccgatgtttggctcatgaagactccctagaagcccagtgtcccctagggaggaagtgccaaattgaaaatttttaaataatcgttactgtattttatagcaaataagtatatgattatcaaatatgcttaaaccctttgggaaagaggagcttgaaaacactgtatccatcctttgacagatccatttagcctaattattcaatgatccccatacattttactcgcattcttgacccaaataattcagattatatttgtatgctttttgatatccttaatgtaaaaaaaattcttgattctttttctcattcattcaacaaatacttgttgagtgaagaccatattctccatgagcaaataagtagaagaatctccatgtgggtcctgcattctaatggggaaagagaggctgataaatactaaacgcaagaacattaagtaggtactatgtcagtaaacaaagtatagagtagattagaaggaaaaaaatcaaataatagcaatgttaggggcgaaggagcctggagttgtgaggatggcttataattttaaatagagttgtgggaattggcctcaggaaggaggtgacatttatgagagagttggaagaggtgcagggattcaccatgtgactatgtgggggaagaacattcagatagggagagcggccagtccagaggctcaaggcaagtctgtgtctgagatgttccaggaagaggaaggaggccggtgttcaggagtaaactttgtaacttagtctttcttttctcacattagactttttcgttgttgatgttttactttaaggaaatttatttttgcaaaaatatgtactatttggtttgttaaaataacatctaactcttgaaagatcatttaccttgatagaggcattcatctattctgttaggaagaagcacaggtcagccggagatgtttacagtacagagttcttatataagtaggaaaaaaaaaactgtaataatttaaaaagtaaaaaaaaaaaaagtcaatacaggacctgccccttcctagacaatcacaacgtgtccactcattctactttcagctgccccctccccaccctatccgttcaatatcctgccactctggcaccatcccagccacaaggcctcaggtcctctctctgctctcgctggttttcagagaggcgctcctcagagagagtttctagcactaaaggataagtgattgttatgacaatatacttctttttaaaaaatgcttgtttcatcggagaattttggctggctatgggtaatggaagagatttcacataaaagttgagtccccttctcacaaagcaaatgagcacatgatggatcaaggtgctctgctggtgtagactaacatatattaataatacacacatacctattaagagatctgtgtcaaggaatatacatgtagtatatattaaagacatcagaatataagacaataaattaaattaccttatagtcacctggcttctatggagcaaggagaatttaattaaaccacagaatctgagagaacatttgatccttggttgatgctaaaaaattgtttcactatttgaaaatagtttcaaatcatttcactatttgaaaaaaaaaaaaagcaagttcagatgggagatggactcatagcttatactatgtcgaaatgcattaggaaagattagtttaagatttcatgccaataaaataactttaccaaaaactacctttatggagtactagtctcaccaggggaagttcaaaacatcacattttttaccaggaagttgatgcattcccttggcaagtcaatgggatggtttatgcctagaatctcagagaagaagaaagcctttttagatgaaaaagatagtcatatgtctccaaaccctcatgtgtatttatgtagtggagaggaaactaattgaagcagaaggtagctagatttttaaatgtaatcattaatagtctcacagttgtgttgatagcatccaacagggttaccttctgggcagaaacacagatcactcctactgttcttggagaaagaaaaaggaggaaatgaacacatgctcactgaacctcctagcaaaaaaagtctctctagaaatatatggtccactcccaagctcaccctttaattctccaatgttacttctgtaaaatagcagtcctgtgatattactcactgaacagatgaaattaaaatatttatattctgcacatgcacgcacggaggaaaatctcacttcaattatagcagttaagaagtctgaagtaattttcccagctagcatttggccattccattgagattgaaggaatctggtatgatgatggttcttattaattcaccctctcttcgttttaaaagaatattatagttcctttgtgatgtaaattgtttgggcaatatgatggtgcactgccttgtgactaaaaagtcgacaagctcaaaggacaaagtattcaggaacaatagctaacatttactgttcggcactttttaaatgttctcggtaagataatttttatttctgattcacttttctttttgcctttccaaaagggatttaagttaattactttttctaatgtgactttgatatttcagtcccctcagatcttccaaggaatttacaggtgaaataccattctagttcttttattttcctagaaactctgatattaaatatgggtgtcacactggaaaattccaccagaataaaaagctaaacaaggcataaaatttacattagtaacatcccattaaaccatcatctagaaagcttttgttacatgattttcatcatttattaaattattttggtgtcttttctggtcttttttgcctgtaggactgaaccttgttatgcatttgtctccatcaaaatggtgtagctgcatttggcattattccttcaacattcttctttattttttccacagaagatgaaattagcttggtttaataatagtcattcctgattactctctctgtggaaaacagcttaagaggcacattattcaattaaagaaagtatttgcctcgccctttaaaaccttcattttatataacctattgattgtgaatccaattagtcttacatattaaacttttattacttttagtatagcacttttacatgccatcgggaaactcatcaccatgtaaaatgcatgtagttcctgactttcaaacaagaggtatttcagaagatcactgctaagtcagtgtttcaaatttgaatatacatgttcatcctataaatgatctatattcagcctataaatgatgacatgattatatatatagtcgtcctacaaataatcatcctataaacaattattgggttcctggggtaacagcaaagcaaaataattagaacatttttgttaataatatacctagtaataataatgtagctgggaaaataatgaacaaaataatatagctgaaatagtagtcctacgttttagggacaaggttagaaagaagagagcaccaggggttggagggagagagtggttcctcatatacactgtgataactcagatagtctgcagtcaggaaacaattggtaatccattaattagagagtatgatgcccttttatgaagtgatagtgtagacacaatagcaatattaattagctttcctattgcttccataataaattagcacaagcttagtgacttaacccaaacttattatctcacacaattctataggtcataagtctgagttgattctgctggtttctctgttctgggtgttaggaagatgatgtcaagatgattaacagctgggctgtggaaagaatctgcttccagtctcattcagtttgttggcagaatccagttccatgtgaccataggactgaaattcctatttccttgctggctgtcaacagggaaccagcctctagttcttgcatgtgggccccgacatctcagagccagcaaacatggaatccttctcaagcttggaatctctttgactttctcttcttccacatccttcttctgcttcaagccagagaacactctctacttttaagggttcatatgattcaatatgtcccacccagacaatcatctctctattttaaggtctgtaaccacaatttcgtgtgcaatgtccattttgccaccatggaatacaacatattcacatattccagggatccaggtgtggacatttttaaagggccattatgctgcttatcacaaatgtaacatgttttgagttgttcttcaagggttcaatccacgaatagcttgtatgcacaaaagcacttgtacaaaagatgaccaccagggctccgcgggctgcctgtgtcacagaatcgagtgatgtccactggcctcacagttcagagctcaccagtactctctttcagcagttcttaatcttatttccaaagatacaccccagatatcctttccttgtgtttacatattctcagactctggctgctgtgttaataagtggtgttgagactattgcttaatgtacagtgaaagagttaaagtgattttgtataaaaatgcaacgatctgtttcactaacattgtcccaagcaacagcatgagcagtcgttttttatattactttaacagaatttcccatccacacaggagaagttcatcctctccattttcttaagagtagagagtgtctttagcatctcaaggtttctgtggatcaccaggagccctgccttggagaggctccagtacacaggtgttactgagctggagggcttgagagaggggaccattctgaggatgggggatggagaaagaatgttaccaaggtgaacggaaaggtagcaaagacgggtatgtacgggaaggtctgagattgctgtttggaattgatttttcaattattaattttttcatgtattctgatatgatgaaaaaaatgacagaacacattaatcttatggaaatgtagggtaaaaaagaggatttgagattggaattattctggaaacctggatcttgagctagaattttaaaaataatggagatggttagcctacagttcggtttctgcttgggaactctttttcaaaaattctctggaaattattaaggcaccaactacttgctctgaaaattgataattaaaggggaaaaaactaaatatttattctgactttaaagggagttatatttttcagtaatcaaaataatcacttgatgatgaatagccttttttatggaaatattgcagttcattaatgtgtaagaataaaactcaccattttgcaatgttaataaaataactgatcaaagcaacgttcatcagtgattaaatcctttggataaaatattaaaaagaactagacaatagagggactaggttttcattataactagaatttggaaccctagaacttattttttctcttaagataatgtaacataaagcagactgcaccatctatgaagcatttctgtcaaaagttgaacctaaatctaattgagcctttatcacttacttccagccaccaggaaatagagagggaaggaagcagttaaatgacaccacaatgaaacaaacagagaaatccagaatgaaggacattttataggactactgacacagtttctgccaaaagttaatgacatgggaaaaaaggagaggggaagaaggaggagcacagctgtaaatttaaaaaagaaagaaagaaaaatgacttgggagatttaccaaatacagtatttgaatcttaattcgagcatatcaactaagaaaaagacatttttgaaaccgttagaaaaattttagtatgcactagacatgattccaagacattattgttaatatgtaggtgagataatatcactgttatcttgtgagacaatgtttgtgcttttagagatggatactgaagtattttaggtatgatgttacatgttgctgggatttgttttaaaaatttttagcaaagacaacatatatggcgcagtgtatattgctcagttgatgggtgcaccaggatctcacaaatcaccgctgaagaacttattcacgtaattaaatgccacctgtactccaataacttatgggaaaaaatttaaaaaatagcaaagaaggccgggcgtggtggctcatgcctgtaacccagcactttgggaggccgaggtgggcggatcacaaggtcaggagatcgagaccatcctggctaacatggtgaaaccctgtctccactaaaaatacaaaaaaaattagccgggcatgatggtgggcgcctgtagtcccagctacctgagaggttgaggcaggagaatggcgtgaacccaggaggtggatcttgcagtgagctgagatggtgccactgcactccagcctgggcaacagagcgagactctgtctcaaaaaaaaaaaaaaaaaatagcaaagaaaaaaattaagcagatgtggcttatttttgctggaaaattaatgaatctaaatgatgagtttatggggattcattatatcatcttttctgtatacaattggtagttacagaatttttcattaatttttttttaaaaaaatcagttattcccacataactgtatatcttaaaaccattgttttctacaaagaggtataatattattgtgtggttgctctgtgatggtacgagtaggcatccttattttatcaagtattgtcctcttaaattgcttggtttcttatcatggtggtctaatttctttgaggctctgtatctcaggcctatgttcattgataaagttcctttctctttgaaattcctattaatagacagtcttcaatcaagaacatattagttctgctaatacaatttatatgaaattttaccctactccataatttgcagaagctaatagtgtactaacaagggagcaggagcaataattgatcatatttgctttcccttagagagaagtgcagccatcagtcttagaagactgatgtaatgagtgccaagtgatggatgccccgtgcactcacgattgctagatctcccatgggtgtcctaaaaggaagcacgtggtctgttgggagatgcagacagcagaattatttggaaataggtggagccactgtcaatgagagacgtttcccctatctctattttaaaaaatgcaattctatcttaatcccttccttttttcctcaaaaatttaacaatgctaattctaagcttgtgtgcacttttcccagtggttaattataatccttttctttattaggttttattttgcagccttaaaaaataaaaagaaattaacaaaatggcttaaaggcaaaattagagcaaatctcattttcttaggagactctgcatttcatttattgttatagttcttacttcagagacagggaaggaagagaaggtagcttgatagtaaaataatatccttcaaggtaaattccatgaatgttaagtcaagcagaacttctatttttgtagcattctagagacattgaatccagtttcttgatgtttcttgccgcatttctcactctgttctacagagcaatttggtttacaggtaatttaagcttgggataaagctctggttaattcagtttctggataaaagaaagagtaattcaacttaaagatcaccatagaattttaatcatagagatgagaaagcaaggaaaggcataaacctcgttagtggtataatgggaaaagaattgtctcagatagatggttctagctcttgaagttttgctgtaagctgtaccagcactagaaaaaaggtacaatgggaaatgcagacctttagttttgtccaccttcctgatgttgcctttttcacttcagcttttcaacaacgttgctgaaaaggtctaccagtcagtgcccattatatatacgtttctcttcctttctccaatcccatctaaataatgaattctgtattccagatcttgatcctcattttaaacattcatttcctttatttaaattttacttatattgttattactttataccttaagatattatattttaattatagtgtttttattgaaatgtaatttttacatcatgaaatgcagactctaagcacacagtttggtaaattttgacaaatgtatacacctgtgtatcccacacccatcaagataatagaacattttcatcaacctagaaaattctgtcatgccaattcctaggtcatcagtgcctttcagttcaaaggagaatgtagatctgatttccatcaacagattcatttcacctgttgtggaattttatagaaatagagtaatacagaatatactcttcgaggtctgactttctgcatcagaaaaatattttagagtttactccatgttgttaaatggtatttcattaaataacacacctcagtttattcacctgtttttcagtttgtggccatttgggatgtttctagctttgaaatattgtgaataaagctgctataacatttttgtataaatctttttatagatctatttttttaaaattctacctaggagtggaattgctaggtcataaggtagatatatgtttaaatttataagaatctgataattttccaaaggagttatacctatttacatatccaccagcaaaataatatagttctagttgcttttcccttaccaacatttggtgcagccgtcagagttttaattttaatttggtccattccagtgggtgtacagtgatctgtcattatggttttaatttgtatttccctgatgattaatgattctgggcactgttttatttgcttattggttattgcatgtcttttgttgtttaatgtctgttcaatttgttgtttaatgtctgtttaatgtgtctattttttcgttgctgctttattgagttatataaatactttattctgaatctaagtcctttgagatatatatttgaatgatacatttcctgccggtctatgattttatgatctgcctatttattttcttagtggtaatatgtcaaagaggagaagtctttaattttgattaagttcaatttaaatatttttctttgtggctagcactttctctgtgttatctaaaaaagctttgcctccccaagttcataaaaaatattctcctatgttttcttccaaaagtttcataattttagcttttagatttgttactgatcaatttcaaattaatttgtgtatctggtgtgaggcaaggatcaatttattcatattagattattcagtcatttcagaaacatttgtgaaaaaaacttaaaatgactttccttaatgaattccctaggaacctttgttaaagatgaattgaccatatagctgtgggttatttctagattatcttttctgtcccattgatttatttgcctatgtttatggcagtgttacagtaccttcatttctgagttttatggtaagctctttaggtactaatgtggaagtatctttaaaacagagtgctgaatggaaaaaatgtacagattaatatgtctagcttttgtctaaaaaaagagaaaataacatatgttcatgtatgcttgactttgcattaaaaaccttggaagaacacaaatgatactaaagacatagttacctgtggcaggtagcagtatatagttactagacatatttgtgacaggaatataaagaggaataggaatttttattatatttttaaacaacatgactatattaattatgaaaagattaatttttaaaaagagtaagtgatataggaaatgtattctttctcagagtagataaaacattgagtgggcaattcattgaaataatgttttctaggtcccattagatattttttgggccttgaaatttttaatatctgttttacttgacaaatatttattaagtgccttttatgtatcaagcaatggtaatacagaaggcaacaagactgacatgttcctcatccccatggtatgtatattccagtggagggaaaacacaataaatcataaacaaataaaaaagatattttcagaatgtgataagtgctataaataacataaacatgacagaaagaggcaagatgaatgtgaaatggaagtcctggagaaggtcttccagtgtggtaacttaggaactgagattggaatgccaggaaggattcagagatgtgaagaatttgggtgttggggaggaacctgcaaaggaaaaggccctgaaaagggaaatggctgaagagaaacaggaaagaaggcaaggtggaagagcacggtgaatgtggtgcagaataaaattgcggcgacaggtagggactaaatcaagctgaactttagggaaatgatgaggaatttgggttttattttacatgaaatgaaaaactactaaaagttattggaagttactgaaagagtataatgatctgatcaagattaaaaaacaaaaagcattcattttattgggggaaaaataacagattaagaaggggttggcagtgagaaaggaagaaaatcagaagttacatcacataagccaagaaacaatagtgtttaaaaaagaagaaatgtcccccaaatgttccaactgaggacagagaaactgtccgctagatttagtctcatggaagtcttctatggtctgacaagagcaatttctatggagtcgtgggtagagaagatggactagaatatgatggaaagtggatggactctctattttatactcacctccccacctcactcccaacacatgaaagtgaatgagaaataaagaagtgaagaaagaagatttagatgactctttcaagtgctctatgtaaccgtagatacatggagatgttgtgtatatccaggctggcatatctgtgtgttggtttagcaaatacatatcaaaaattcttacatgaaaagctcctttataacaagatgttctcacttttttagtgacaaaatcccatgaataaatccaaaaagagtctattttatataaaatcccaccctgttggaagtattgcaagtttccactgaaatttttaatctgacttctagatatatttttggagtgttgtctattttgtcagcctgccagattatgtcaaaatgttgatatgtaataacagtttatctcgtgttcctttatccaccctatttacccacctcagctgtgttaactgtccttgactgattccactgcatcattaatactgccatagggaaccgtgccctgatcattcatactgccactaataggatgccaagtggatgtttcaaagttggatgctgatgattatcattgcgatgtatatgacatcgctaagacagcattttcagtcaaaaatatggctgccgtttaaggtgtgagctttttgcctttttacctagaaaaacaatgatatgtaaatttcttattataatttgtattactctactcttatttgctatttgtcaactctgcaagagacaagggttggtacagaaaatatcattttatcagaaggaaaccttgtcttctacagtaggtactaccttcttgagctgattctggataataaagcttgcttcgcaataatccagagttttccaaaccatatatttgactccctttactgactgatatgcaaagttgtgtttaactatatggaaaattgtgaatccttttcatccaagtctacacactccacttgcttttcccttctaccttgaattcatgtgcattcccccagttttctgcctttgtaatggaggcttcagttcttctgcagccacagttgcaggaaacccaattgtaatcagcagctgccctgctgctaaaagctattagtgccaatgttgttaatgaccgacccagttgaatgtgctgatttaaggggtagacttatttcttgtcactccctagggccttgttcttaaatgagatttctacgttgtttagttgtttactcctctagcataaggagtattaaccactaacaaccacacttcgtatatcagcacgttgaattgaaataatggggaggttaagacatatcactacctttgaggtatgaagacacgcgccctgaaaaaacttggctcctacccctaatttttgcctaaagaagttggataccactgcaatttgctctgaagttatacatgttattgtcttcaagggactataggatgagaagggtacagttaggtttcttttcagaactaaacacattagcagtaacctgcaaaaatcaataccaattacttgcaagcaagggcttaaaaaaaaaaaaaattactgaagctacagaatatgcccataggtgaatggcttaaaacaaagaaaatactggcatagctggtactctcacaaaatagaagcaaaagtagtaaagttctcttttatttattttggcattttggtattaatttgtaaaagccaacaactgttatatttaaaaagaaaaataaataaagcagcaaataactcaatataagaaggctattttactgtctccctggcatgactaaggtttgtgttgtctttctagcagacatcaaggcattcagaaggtgtatggggatggcttatctatataaaccagtaaaccttttattcaatacccagacattctgcatgccaatattatgtgtttagtgtctcgagattctatttagcagaaattcactttgaggggcttggtgaagccttcagaggtttaactgtgtagtctctcctttattcaaaaggctgaaataatatttttccggtttctggaattcttaagcttgcatttcagattaaactatcgcagagagtagaatttcttccttccttgtcttctagtagtaaagatggggcacatatctgtaagatgtggacccagaaactctactctcaagtctggctatgatgacgaagtcttgagaagctagtaagccttgctacctcattcaagtccacggtagagttgtgtatgaatgtatggagaggtgggggaagttccaaatactacagaatttccccatagttaacagccctgcttaccaaacaattgaggccatgtggaaatggtacctatcattaaatctcacatcagaaggaacgagttttggcatgtctgtatcgccaatatgagtatcaaaaaaggtaactgtggatcttcttggacagtcattttcctggacttcagtttggtcctccctggtcataaaatgatatgattcttaatacttgaaaaaattgtcccaaaacacaatatcacccaaaaaaaccctcttttaccagcttcctttttttttctttaattgcagagcctcaaatcgatatttaagaagtaagagaagtgaatggtggtcacacaatgcctgaaaaagaaagctctgagtagttgtctgggggacactagaaacaaaagaagtgtgtcacgtgataccataatggcatccagcactttccatatagggaaggcagacagggaaaagaaaattttgcttaacgtggattgaggaagtagtggactcaagtaatggaaaggaaatgaattttacagtattctgaggtactggtaaatttacttgctacggattatactgaaggtaaaatgctgcttaaatagagtctaagattttatgtatcaaatatttacctaatttttaaagcattaaaaatgttaggattcaatagttatagttactttcatcctttgaaacaaaaataattcttgtttcaattttatatgttgagctgttaaaagaaaattgaaagaggcaaacaatatatacttatttgtctctatgggtttgtgcagtttatagatatcctgagcagtgcttctagtgagcgttcttagtagcaccaggttggttgttaatggagtattgacccagcaatttactggggcaagcccttctgctctactcagagttgatgtgttttatattacaattgcatctaataccttattttacaacttcaattaatatagttgggtagaactcgaagaaagtttataacaaagctatgaatagagtaattcattattataaaagtgtactttgagaggagaaactaggattgtttttcctcagaaagaaaacactgatgtatgataatagtattctccaataaaattaaaaataaacatctaaagagacataacatttctgttgagaatagaaaacctgcactcgctgtctgcaaacactgggataatatctttcacaaaatgtttataatccagataaaaagagaagatatatatgtgcaaatcaagagaagaaatgaaatagagaagaaatgagagaagagatgacaaccactaaacaaagagtggagagagagaagtgctctgacagttggagggcaacagagatctctctgcactgaggaggccaaggaaggctttttaaaaagatgatatggggtgtgggtgttgaagatagaaggtgggatgtaaaatataagaaaaagggcaaagtttttgcacgaaaccttaaggtgaccattctcacttcggttccttggtttttgtggagggatagtaggtagtaaaattagggtgagaactttgaggatagattgagggtagtaatttacatcaggctaaggagttgtaggcattctcctataagccaggcaatagaaggccatcagaagtttacaagctgggatataatatgacttttataaacagcaatatgccagttgtgtgaaggatgagtttagagaaagactgaagctgagaacactaagaaaatgttttaacagtgatagggaaaaagtaattggatattttggctgaactccttaatagaaataatgaaaggaacacaaaaggaaaacacaaaatctagttcaatgaatacttaaaatttataagtgatagtataatcctataatttattctgaattaagaatccataattctgattctataattggaactatcccagaattctatgtcctatttgacattagtttgacttaaagattggcttatgtctcaatcaatcaatttgatggtgaccaagaatttcctttcaatttacagtttaatactggccagagaatggaaagtaaaaagccatagcacatgctatatatatgatccatagacttatcaaattcaaatttaatggggagtctaaaacagctatttggcatttataccccaggttttttctaatattttatcagagatatcaaagagacttcaaactcaattcactgactgatataaacagcaagctatttcaacagatagagaacgctgggataaagaaaaagggcttggaatttttttgaagtgaaaaaatatgtgtaaaaaatgcatttctaatagtcacaggacaaaagtggacagaatttcccattacagtaaaatttaatgaattcagttggttcttttaaccatcatatggtctcatcaagaaataagaaagaatatcattaagtggatatccccctttacataaaagctgaatacattttttttttttttttttttgagacggagtcttgctctgtcacccaggctggagtgcagtggtgcaatctcggctcactgcaagctccacctcctgggttcacaccattctccaacctcagcctcctgagtagcgggactacaggcacccactaccaagctcagctaatttttttctattttcattagagatggggtttcgccattcacaggataaaatctgaatacataatacattttaaggactgaaatcccttctataataactttagtaattactcactgttgatgaaaaatatcctaggccaaaagttttctctgtttgccccaagcagatggagtaagggctctgagtcaacctgacttccctctgcatggtgtcaagcactctgtggcttcatggccttgcaatccagttaatccctaggaaccaaacttacccaagtggttgtgtaagttgtacataataaatgtaaagtgcttagcatagcacataaaatgtaaagtgcttaacatagcacataacaaaaaaaattgttgagtaaacgaatattttgctctaaatagtgtgggccacaagatctactaaacaaattagattgtaaaacttctcaagggatatcctcggtgtatttggtagaggaaagaggaaagagatttgtaaaatgattgaaatatgttacttacctttaggattttttttcttgccaagctttgggttttgaacttgcggaatcttagagtcacaggaagaagaaatagatagctcctgtagtgctggctatagtctcatagagcccaaaaaggtaggaaggagatgatttagaaagtatgagagggtagaatgccagggaggtttctgaccagttgttttccaggccaaagcaagtaatgcaatgacttcttgtattaaacccatcatttatttaatcaaagataaagcatatttctattatttctataataatagaaattctacaagaaaggagagaaacctttaagttttccctaaagaaagccattcttcctattcttatgatttctgatgctagctacactgctttcaaaacacacgatcctttagggtacagaggagagaaaaggaattcgtttaaaacatgattttctatgtagatcatcaacgaatgaagaaagaaactagaaaaaagggggaagaaatgggtgaatgtagtatacttatttcagatatgaagatgtgcttccaggtacagcactagaggtacaaattcattctagagctttgttcactgctacttactatctctggaactacagtcactgcagaaccagggcattgaagcccaaggttaatacagattgtagggagcagacaaaattggatcgaagtccagatttccttgttttctaactggaaggggcttgggcatttcatttaataccactaagtttcaatttatccatatgtaaaatgagcctcatagaggtgttataaggaatcatagattactgcattcttccattctatgacataggcacatttcacattttaattgggatgattcttaaaatcaatggcacatcttttttggaagtgccacataaagtcatgaggcatcaaacaataaattctatcttaatttgataaaatacatgaaggtaataaaggcaaagtgcctctgacaacatctggcatctaataagcaccagcaaattgttttggggtgatgctcagtgctgttgctattaccccatgctacaccactcagggaagcatctctttcttcataaatgttcactgatactccagctcaagtgaatgcagtctagtgcgtattttgtgaaagagtaattaaagtcttaaatgtcctagtttctctaatcatctaaaatatcatacttttaatataaaaataataataccttaaaaatgaaatgatacatctttggaacatttatcaccttcaaaggacttgcaatcctcctacataataatggtactatattacttagttcttgggtatgaagagtctgtactgcacatagcactctgctaggcacgagttttccttgttttttctaatacaactttgatatgacctaatttcaccaccaaaaaaaccagcaccatatggcaagttccccatttcccctaaaataatttattgagcctttagtgtgtcccagtgactgaactctttatgctgaatttttctcaagatttcttcaggacatcagaacataatgcagattttttttcaggtggccctctaccaactggatatgaaattggatcagctggaggcaagaacagatggggttgagcagcagatggaaagatcctgtttaggatatgcagaatcactctggcaaaatcaatcatgccacaggagttagtttcagtttggtgaaagaaaatgaactcaagtagacaactgagttaccgggaaattaatacgagctcacactttagaaagtcttgattaagtgtcaataagacagatgagctaatgatgttgaattaaaagtcttaaatgtcacgtttgtcagtgatcataatagctctccatatttagtgcttaccctttaccaggcatttcaggtacagatctcattcaatccttacaaaaaccctgtgagacaggcatttttccgatatcacaaatgcttaaatggaagttctaagtaaattgatcaaggtcataggactctaggtaacagaaacaggattggaacttgtctggctagctggaaagcccacacaaatcatgaacactctactactttccagtgttaaatgatgtgtatacaagaacaattggaggagcatacggtcaactttcagatatcctaaggtcctttccacagtaacaattggaacaggcctgtgatggtcagagtgaccaccgggcatctgcttgaatctttgtggggaatacagagcagcgaggggggccacatggtccccagtaaagcagaggtcacaggtgtcacatacaggctctggtgaatcccacggagtccctgtagaaatctcacatctgcttaccccgagaaggtctcccagaatcctggagctgccttgctccagaagtggatctccatagcaaccttaggccaaaagagtctcatgcacccgttctagtccaaacatgctatgatggactttgtttccatggggcattcaatacatatgtgaatctgagattgtgagtggcttggagtacgtactgtctcagtccattcgggttgctattaaaaaaaaaaaaaaaacataaactaggtggcttataaacaacaggaattcatttctcacggctctggaggctgggaagtccaagacctgccaaggtattggtggatctggtgtctggtgagggggagttttctgttcatagatggctctttctagctgtgacttttcatggcagaggggaaaatgcactctctggggcctcttgtataaggtcactaataccatatgtaaaggctctgcatctcatgacctacttcccccccaaaaggccccacttcctaacatcactttgggtgttaagatttcagcatattaatttggtgggggtcacataaacatccaatccactacatctactttcttcaaaactgtaggcaagctgtaaagaagggaaaatcatttcagcccaagtattcgccctgctttaactttggagcaaaagcaggaaatagaaggaacttatcattcattgactgcctactatttgccaagcatggaaagaccatataatgggttggagggaaaataagataaaagtctgagcaacagatggaaacacatctgccaggtgccatgctctgtacgcattacttcattccatacagcattctcttgtattagtgagttcctgctgactgctacgttactttttcttctcagccaaatgttcaagaagcaggtactggttatgagtaagcatggtgaaaacccattttctaagaaacagaagagatggcaagtgtatcctctcaaagaattaaattttgttttctgccttatttttctcaaacaaaacaagcttttaccaattgcattaccatagccttgctatctatacataggtatcacagaaatcttaatctttgagttttcaagttagaggaattcttattaagcatgagagttaataatctcctgagacacaaatatgcctggtaatatgagaacaataaatgtttgttgggtccaaacatgaattaaagctgtatatgttatgccttaaagacattaaattaatcataaattatagtgattaattacattaaaacagtagcattatgaatacacaagatacaagtttcagtttaaggaaaaaccatattttaataatccccaagtacgcctgtattctgagacactaaaaataattatatgctactaactataccttgaaaacgcatacactcttactgaagacacagaaatgaacagaacagaactaaaaattgaatacattttgtgacacatgatttttttcattgtaatatttctgaaatttggatgcatcttggaatctatgacatcttatagttgccttcagccaggtggcagtcgtgatgtcacaagcaatgcttgcatgtaggagaacaacgtgtaagacacatgtcagcatcttgcaagaaaacctcagagtcaattacagaccactcttattattcctaggacctacttgttttgaaagaagatgggtgagacaatgtattatatatgtttaacatacaggaagcaaaagtaaaaaaagaagtctagttctatgtcattgccaaatgacttaagagtctagcaccacagcattttagttgcttaacagatttaaatgttacattgcgcttgctttggcagcacatatgctaacactggaccaatacagggaagatcagcaaggcccctgcacaagaatgacacataaatgcataaagattccatatttttttggaacacaaaggataaatgcttcaggggattgacacccaattttccatgatgtgactgttacacatggcatacctgcaccaaaatatctcatgtaccccatgaatatatacacctacaatgtacccacgacattaaaaataagttaacattttttaaggaaatattacctcatcttatctcttgatggcatagaaatttatattttaaaactgttatatataattatataattttataatcatacaattatatttttatatttttaaataaatatataatttaattatataaacatttaattaaattatacatttaattatataaacatttaattaaattatacatttaattatataaacatttaattaaattatacatttaattatatattaactatgtaatttaattgtatgtttttatatatttattatataatatagatccattatctatatttatacatatatctatatacataatatatttaatatatattatttatacagaattatatataattaggcttaataactctgagtcaaaaacgtgattcaaagagtcaaactctacatgaaaggaagtttcagaaatatctcacccaattaactttgcttatattttattttaagtatatttaattatatttcaatatatttttatatttcaatatattatattgaaatatattatattgaaatatattgaaatatatatttttacgtttcaatatattatatttttatatttttatataaagcaatatataaaattatatttcaatatatttcaatatattatatttcatattatatttcaatatatttcaagatattgtttttatatttttaaataaatattttataatttaatgacatataaacatttaattaaattgtacatttaattatatattaactatgtaatttaattatatatagttatatatatttattctataatatagatcattatatttatacatattttatatgttatttatacagaattatatgtaattaggcttaataactctgagtcaaaaacatgattcaaagagtcagactctacatgaaaggaagtttcagaaatatctcacccaatttattttgtttatattttatttttgtgtatatgcaataaataatttaaaaatttataatcaagctgaaaagagttctttcagcaagcacaaaattttccagtgattaaaatttactgagtccgtttatttggtggtatttttcttaggttttttttttttttcatgaaacaatgataactgctagcatcgtagatacaacaaaataggggtataaaaatatgcgggaacatgaggagatggtatacaaatctacagaggcatgaaacaatagaaattagcgccaatctggaagttaggagatagagatcccaggcttggttccataattaaggagctgcgtgatcttgagcaagtcacttaatctctccgagcttcaaccataaaataaggagctgtgatagataatttccgagctccagagagcagtgatgtaagcaatcaggaaaatagaaccttccctcgatgctccaaggaagaagggatctgatgtgggtcactatgtgcttatgaaagtgacggaaaggagtcctgaggttgaggaaggccagtcactgctggcctcagcttctctaatggctaccgagggattagacattgcctccaggcaggtcagaaactcaaggaaacttccccacaggtcacagcagcctccggtatctattggtgaactgctaaaggctactaaaaaccctttaggttccaaactctgcatgtcagcaggccactgccccaatacacacttctctgccatccaaatctcccacaggagtttcttactggtcgcatccaagacaaagctctgttaggcaaggggttctgggaaatgtagttcctacactgccagtccctgtgctgtaggagagatcatagaatgaggtaggaatggggctgagtgtcacagacagatatctggtaccccagctggggagcgagggactatgatggcaacgcaggtgaacaagagggaggggacggcatgaagacagattcagaagtcatggagaggaaggtacacatctgaaagacacctcaaaggaagaattgaaagattagatatgggttactttttctttccacactagtgagtcaatataatctataaatcaagtctctttagctcctctgctgactatcatgttctttttccctagctctcctgtaacagggaacaatacaccctttttcttgtagtgcaagaataatgatttgctggcagaagctccgtgaatcagactttgcactgaacatgttatattgtttgggaacccagctaaatttttccatgactgctttaaaagtgatttccatttaaagctaggtggaacaaattcctgctgctggctaaatcttctttttcttttccaatgaacagaatctcataaaaaggactattgctcttttgtacttttctgtgatgcattttgtgttggggtctatggaggaagccatctaaaactacagagtgttgtaaaaataccctcgtaattctactagaattcaactttttaatagctgtctttcttctccttttatatctccttttcaattatttctttccctttggtactctgacagactaatgtttctgggtctttcatagacacctacatcgaccaaatggatccatctcccacctttgagatcctcattaaactctggcagagtttggtggctacatgaactcaaaccccagacgtatggagaaagaatcactttcaatagaaaacctaacatcaccagtacttacaattctgactaatttttgtcataaataaatacagtggacgtcatttatgtccattttgagtctgtatctatgttatatcacactttgcctaataataatgctgctgtcaatttaatgagggttttagcttacataaataacaaacattcagttcagtggggtttatcttaaactgtacagaggtgcttgttttattataattcaactgaatcagaaactttctttctctccacttgctcacactggcttctaaccaactcacgtttctttaatgacaagtgctaaataaacttcacctggggactgatctgccaataaggataaaaaaaagaattgccccggctaccaaagtatcattgtttcatctccaatgaaacattcccctgtaaaaccatttctctctatgcaaggacttggagtaggaatccagccacagaggtcagggaaggccccaccaccaccatccccactgactcagaaaaggattaaaatattttaaagaaggaggaccagaggacaaaacgtcagcatggtcaagaaaaagtgagcagagccatgaatcgagtgatgaagttgtagattcatagaaaacatgtaaaggctatcatatatgtagaggtaaagtgtcactcctcgttttaagggtgaagaaatgaggcttgcaggagttaagtgtcacacagcagatagtggccaagatagtggccaagccaggctgagtcccatgtccaaatcagtgtactgcttgcttctctgtgcacctgtcatctttagtggtggtgaatggatgagcagtattgaggttaataccctaagaaataacacagcaataatgctcaagtgtaatctagtaataataatgattggaaatcaacattactgtagtgacttcaattgtgtgccccaaaaagatatgtccaagttctcatccctggtacctgtgaacatgaccttacttggaaacagggtttgtgcagatgtaatgcagttaaggatctgcagattaagatcatcctggacttagaaatctactctaaatccactgactggagtcctcatgagagaaaggagagagagctttgacacacagagaagcaactcatgtgaagacccatgtgaagagagaggaagagattgaagttctgtggtcacaagaccaagaatgccaggagccatgagaagctgaaagaggcaacaaacctcctcccctggagctgtggagggagtgcagtcctgctgaggcctccattgtggacttctggcctccattgtggatttctggcctccagagctgtgagccaatacattctgtggttttaggccatcaagtttgtggtcagttgttacagcagctttaggaaactaatacaactatgaaaatacccaatctaaaaagcaatccaggaagaaatttttgttgtcctagtggtttgttgttgtcattgttgattttaacaaaatatagctcaaataacagtactttgaacttttcagttaggaataattacacacgtaacggctcccctaaatgttttttagcctaaagactctgtcaacatttaatattatataaaaggctctgtctacctccccagcctcgtgtcctcccagccttccccttcccccagtattccagccacactggtcttctctttggttccagaacatgctaggacccttctcacctcaggcttctatgtgctcctcctttggctggcacactcctcccccaccatgcaccacctccccagtcaacatcagctccaaagtgcaactctacgggaagccctcctgcccctttataatagatcagccccacacatacactctctttgtaaactctcctaacaccctttccctcttcttcacagtcatgatcattgtttgtaatttttcatttatatttctggattgtctgtctttcctgctggactgtcactctctgacggcaggcacaggacattttgctcatcatgacatttcatgggtagcatgatgcctggcatatagcagccactcataaatatttggaaaataagtgagtgatagtatttagccttggatggagctcttgtctgttattcaaacttatagctgttctgtttccaacatataaaattgaaattgtagaaaaatctgtacatagtcataatttgaaaattaacttattttagtaatgtcttaatttttctcctctgagtttctaaatgaattcatgaaagttctgctttgtcccaaaggcatttcataaataagtaagcatagctaaaagggactcaaacctgttacatttcaccatgccatccgagttcatggataggtgaatttgccctaattagtattatccatttatataatcaataagcatgttgggtaccgtattagtccattttcatgctgctaataaagacatatccgagactgggcaatttacaaaagaaagaggtttaatggactcacagttccatgttgctggggaggccccacaatcatggcagaaggtgaaagtcacgtctcacatggtggcagacaagagaagagagcttgtgcagggaaacttctctttataaaaccatcaagattcatgagacttattcactatcatgagactagcacaggaaagacccacctccatgattcagttacctcccactgggtccctcccacaacacatgggaattgtgggagctacaattcaagttgagatttgggtggggacacagccaaaccatatcattctgccccagcccctcccaaatctcttgtcctctcatttcaaaaccaattatgccttcccaacagtcccccaaagtcttaactcatttcagcattaactcaaaagtccacagtccaaagtcttatctgagacaatataagtcccttctgcctatgagccagtaaaaccaaaagcaagttagttacaccctagatacaatgagggtgcaggcattagataaatacatcattccaaatcggagaaattggccagactgaagaagctaaaggccctatgcaagtccaaaatccagcagggctgtcaaatcttaaagctccaaaagatctcctttgactccaggtctcacatccgggtcacactgatggtgggctctcacagccttgggcagctctgtccctgtggctttgcaggctatagcctccctcctgactgctttcatgggctggcattgggtgtctacagctcttccaggtgcatggtagttctccatgagcaccccgcccctgcagcaaatttctgcctggacatccaggcatttccatacatcttctgaaatctaggtggagggtctcaaacctcagttattgacttctgtataccttcaggctcaataccatgtggaagctgccaggacttggggcttgcaccctctgaaaccattgtccaacctgtaccttgaccccttttagtcacacctggagcggctgggatgcaggacaccaattccctagactgcatacagcacagggaccctggggccaccccacgaaaccatttttctctcctaggcctctgggcctgtgatgggagggactgccacaaagatctcttacatgtcctggagacattttccccatagtcttggtgaataactcggctcctcattacttatccaaatctctgcagccagcttgaatatctcctcagaaaataggatttttttttctatcacattgtcaggctgcaaattttccaaacttttatattctgattctctttttaaactgaatgcctttaagagcacccaagtcacctcttcaatgtttttctgcttagatattttttctaccagatactctgaatcatctctctcaagttcaaagttccacaaatctctatggcaggggcaaaatgctgtcagtctctttgctaaagcataaaaagaatcacctttgctccagttcccaacaagttcctcattccatctgagactacctctgcctggattttactgtccatatcattatcagcattttggtcaaagccattcagcaagtctctagggagttccaaactttcccacattttcctgtcttcttttgagccctccaaactattccaacctctgcctgttacccagttccaaaattgcttccacattttttggtatcttttcagtagggctccactctacttgtgccaaaatctgtattagggttctctagagggacagaactgataggatagacatatatataaagggaatttattaagagtattgactcacatgatcataaggtgagatcccacaataggccacctgcaagctgaggggcaaggaagcaagtccaagtcccaaagctaaagaactttgggtccaatgttcaagggcaggaagtagccagcacaagagaaaaatatagaccagaagactaagccagtctagtctttccacgttcttctgcctgcttttattttggctatgctggcaggtgattagattgtatccacccagattgagggtggatctgccttccccagtccattgactcaaatgttagtctcctttggcagcaccctcacagacatacccaggaacaacactttgcatccttcaatccaatcaagttgacactcagtattaaccatcacaggtacctaatagattccaaagattgtattttaaaatatgttttaatctatagaagagaaaaagaagataacaagaacagtaatgagaggtaaatcacagtgaggctgggtggcggtaaaggaacatttccagaggcagtcactcttgagctgagtcttaaagagtaggagaaagtgagtaaagaaagccatgaaggttgttttaggtcagggtttcttatttttgacatttttcacagaataattctttgttgtcaggggctgtcctgtgtgttttaggatcttaacagcatccctggcctctgtccatgaggtgctagtgtgacaaccaaaatgtctcctgaagatttctcaatgaactgaaaacagaactgcagtttgatacagcaatcctactactgggcgtctactcagaataaaagaaatcattatataaaaaggatgcctgcacttgtatgcttattgcagcactattcacaatagcaaagatatggaatcaccgtaagtgtctaatggatgattggataaagacaatgtggtgtatatatgtgtgtgtgtgtgtatatatatgtgtgtgtgtgtgctgtgtatatatatatgtatacacacacacacacacatatatataccatggaatactactcagccataaacaagaatgaaatcatgtcttttggagcaacatgaatggaattggaggtcattatgttaaatgaaataactcagaagcagaaagccaaatacctcatgttctcacttataagtaggagctaaatgatgtgcacatatggtcatagagcatggaataatagacactggaggctcagaaagggaggagggtgggaaggggaatgagaaattatctaatgggtacaatgtacactatttgggtgatagttatcctaaaagccagacttccccactgtacaatatatctgtataacaatactgcacttttaccccctaaatctataaaaatttaaaaattttaaaaaacgaaaacaaaatgtcacctgacattgcaaaatatctcccctggaatgcaccttcttcccagttaagaaccactggtgggggcagaggaaggagcctatctgcagttgggggtgtctgagttactgcagcatgtccaggtagctctaggagagtgcccgggagggagataggagagaaagtacaacactgctcttacacagggggtttcatgtcttatgctggggagtgtggaatttcatcctgaaagcacttatgcagaatcaaaggatcttaagtaggaagtggacatgggctaatttgtgcttaagaaaaatcactctggtcacagtggaaaggaaggatcgaatggagatcagaatgaatttgaaagaattgaatgtaatccagaagagaaatgattcatggggacagaaaggaaaggaaagggaagatagaaaggtactcacatcacatctctaagaccttgtctagaatgggatctagattcttggtttggatgatcagaaagtagaatcataaatcttctccaaaatccacttggaaattagccctcatgactttatgaaaaaaaaaatcaaacccttgaactcagaaaaattacttgtaaagttggttaagcataatctaggtgacctcatgatgtaataaataaaaatagccactacctccggcttcaaattcaattaggccttcagcaaagattatttcagcaaattgtcaaaaatattagtttttaatcaatgtattagaaaactgtagtaaattttcaccccctgcccccaagcaatgtctagacaagtgagacagagagacaaaatgagtaattgaggccatttttcttgcctgattgttcagaaaattgcctcatttctttgctttattttctgagtccacataatgataacagaaaaagttgtatgtgtggatattttttacaatctgaatctttgacagtgttgagagaggtaatcgccaacaaacacactatcacagcatttgccagatcgtctgttttctttcaggcttttgtcagtatctaaggcaagtcctttgtgtgagaactgactagataaaatgtcatgagcacctcctgtgagggaaagaccgagactgagatctcagtcataaagagactccccagctacaggtgctacaaggtgtgcaaaggcaattaacaatttggggcaaagcgcaattttcatagactctgttttgcaaaaaaaaagaccctacgctacctatttcacaaagttattcacatttctagctcatgaggaacacaggatattcaggccctgctaaaggatatgaataggtcatccaggttttgattaagagattgtttgaacaagtcccaagtgggaataattcaaattaaagcaagaatgtgtcaatacatctgaaatgttgaagaatgcaaaaatagtatttatacataaatataaaatataaatggaatttttatgtgttgatcaattatgtatttttaaatatttggcttcaataacaatataagaaaaatgaaattcctactaatccatagaataatgtgtactttcttttaagaaatcaccaaccttaaaatcactaaaatatgatacatttaacaaaatggtagattttaaattataaaccaaactgaattcagaaagtaaaaattatgatacacagtttatattggtcaaagttgccattaattgtttattatcattaaaaataaatacatatgtttcacttcacatgtgttacacaggtgcttaatattttattaatataaatgcataattcatttgctcttcacaaccacaaaaactagatacatgattattcccattttgcagataaggaaattaacacccaagtgaaatactttaccaaaggtcacataggtagtaagtaacaactgtgtgatcagaggagagcattatctccaaacttcgtgagagacacatataagcaattagtcccttacagactaagaaattttgatacagacaatttgttgcagattcataagatagtacagccagttctgtgaatcacagtgttatatttatttccacatattctatgttaataatataatttttaattccatgtattttaagttttcattcaataactgctataagtatatgcagctctgagaacaagggggaagagaataatttcagccatttaaaaatagcttttatatttagatttaaatatttcagttgcatttcttttttttttttttttactttttacttttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggcgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctcaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccaggctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttacccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagctgacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtgctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaagtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttatgtctctatttccttcagttctgctctgattttagttatttcttgccttctgccagcttttgaatgtgtttgctcttgcttttctagttcttttaattgtgatgttagggtgtcaattttggatctttcctgctttctcttctaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggcttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttctaacagacaggaccctcaggtgcaggtctgttggaataccctgccgtgtgaggtgtcagtgtgcccctgctggggggtgcctcccagttaggctgctcgggggtcaggggtcagggacccacttgaggaggcagtctgcccgttctcagatcgccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgttgccgccttgcagtttgatctcagactgctgtgctagcaatcagcgagattccgtaggcgtaggaccctctgagccaggtgtgggatatagtctcgtggtgcgccgtttcttaagccggtctgaaaagtgcaatattcgggtgggagtgacccgattttccaggtgcgtccgtcacccctttctttgactcggaaagggaactccctgaccccttgcgcttcccaggtgaggcaatgcctcgccctgcttcggctcgcacacggtgcgcacacacactggcctgcgcccactgtctggcactccctagtgagatgaacccggtacctcagatggaaatgcagaaatcacccgtcttctgcgtcactcacgctgggagctgtagaccggagctgttcctattcggccatcttggctcctcctcccttcagttgcatttcaagtatctttttctgctaagaatttggcctgtctgaatttcaaaaggcatttgggcttcaaactttagttaatggtaaaaaaaaaaaataactaaatatttaatttcctgaaatagttccaaattacagaaacagagagaaagcttaaataccatagaacaaaaattcatagaatagaatttatgaatcatgattcatacacaaaagaccaaacctctcaatgaataactgtattgttgacagtttgggaggaattttaattttgtttttttttctcaaatagtgagatcagagtcggaaaagccttaacatctccatattagagattctgtaactcacatcacttatgccaggctccagctacgtactctgaaaagtatattaaatcagaatgaaaattgttcagtaaaatttctcctagaggtatagtaaatatgattgatttaatacatcattgagattctactggaaaaatggcataaaacagcaacattctgttgccattttataactttcatttttgtaaagtgaccattagcataatatagtaatatcattatgacaatctgcacagatgaaaatatctcaaggccaatattacattttcatcaagtaaatgaccatgtgtttcaataaacacgattatgaatgttaatataccaacagattgagtattttcatttctcagcatcattgtttgtaggggaaaacaaattaatcatctttgagataacaggagtgtagacttttagaacatgatctgtttcactacaactattcttggtttgctgaataagagtcaggattttactccagactgtcctcatctgaggtcatcttatctgtccccttctgaagtaatcttgtcattatgtaaatacctatgcagcattatcaatttagagccagataatttaagatgaatcacgtctttattttgataagtatccacaggacacccatttgtacagtagaaacatgcaaagaaacctcttcctcctgcctgttctattgtcttggacaattcctgaataagctgttctccagccctgcacacctgcgagcaggccagggactctgtggacccagccatgccctttctgtcaccaaggccacatttgtggtcaggaggcaagtgagatggtcatcactttcacttaagtcctttttagcaataggcatgttaggcattggaatggatgtgcaagcgaaatggacacaaaccaaaaatggaagaggcaacctgtctatggccttaccatcccgaatatgcctgatctcagaagctaagcagggttggtttggctagtacatggatgggagaagagataactagctgagacttcagtatctagcttataggctgcttcagccttcaagcacagcttaattatatgtattactggggaagatccttttctggaaagaggcaacattttaagaccattcaagattaacctttacttgagcaaaaagaaatgtttctactttcaaatgctttttggtaaaaatctttaaaaaataataaatgcttcaaagagaataaaacagctaggaatccaacttataagggatgtgaaggacctcttcaaggagaactacaaaccactgctcagcgaaataaaagaggacacaaacaaatggaagaacattccatgctcatggataggaagaatcaatatcgtgaaaatggccatactgcccaaggtaacttatagattcagtgccatcccaatcaagctaccaatgactttcttcacagaattggaaaaaactgctttaaagttcatatgcaaccaaaaaagagcccgcattgccaagacaatcctaagccaaaagaacaaagctggaggcatcacactacctgacttcaaaccatactacactacaaggctacagtaaccaaaacagcatggtactggtgccaaaacagatatatagaccaatggaacagaacagaggcatcagaaataacaccacacatctacaaccatctgatctttgacaaacttgacaaaaacaagaaatggggaaaagattccctgtttaataaatagtgctgggaaaactggctagccatatgtagaaagctgaaactggatcccttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagccaaaattgacaaatgggatctaattaaactaaagagcttctgcagagcaaaagaaactaccagcagagtgaacaggcaacctacagaatgggaaaaaatttttgcaatctacccatctgacaaagggctaatatccagaatctataaagaactcaaacaaatttacaagaaaaaacaaacaaccccatcaacaagtgggcgaaggacatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactaattcaaccattgtggaagacagtgtggtgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatatccatcaatgatagactggattaagaaaatgtggcacatatacaccatggaatactatgcagccataaaaaatgtcctttgcagggccatggagaagctggaaaccatcattctcagcaaactatcacaaggacagaaaaccaaacaccacgtgttctcactcataggcgggaattgaacaatgagaacacttggacacaggaaggggaacatcacacaccaaggcctgtcgtggggtggggggaggggggaaggatagcattaggagatatacctaatgtaaatgacgagttaatgggtgcagcacaccaacatggcacatgtatacatatgtaataaacctgcacgttgtgcatatgtaccctagaacttaaaatataataaataataagaataataataaattatttttctgatttgtttaaaaaaaatcactgtattccttggctgcagcacagcagcaaatgtagctagtataagaactacttatcctgggtcccaaaatatagttgcttgaaaaagtctatattgcgaccttaatttttagtgctttgcctctttgggaactccagtgtgaagagaggtatgcacaacctcacggtcctcaggttgttatcacatggccgaacactttacaacatgaattcatgaattatgtagttaattattacatcaaagaagatctcgccgcacttatcacaaacactcttagttatagccccacaaccttaattgttattgccaagaatttctttccatccactcttcctattttgcaaactacaattacagaggaggtatgaatgaaaagttttctgtatcattccaaaaatatgttaagatgttctgaaaagttctgattccttgatctacgagtgacttagcaacatgattagatgagacaaaacccatagctacacatctttctctagaagtcttaatgtcgactcttgacaaaatttcagatccattcaaaatttcaaatacgttaaaataaaaaaattaacactctaatgttgagattgagtagactatacaaagccttccttaaagattacattttttgcattttctagttttcattcattgcaagaatgtttgtaattgctcagtgaatggctaatttcaaatctgtaccaggtaattctcacatctctgtcatctcacggctgacacctattgattttctttctttttctttcattcactttgagatcttcctggtccttgacattgtgagtgactcttggttgaaacctagacattttagatattattttatgagactacggatcctctgctggttgaaacctagacatttaagatattattttgtaagactatggatctgctgctgtcatcctctctctgcttttctttttcttctccacttactcctacccctttaatccagtgctcaagtaggaccagggaaacattaaaagttggcccacagatggaaggaacattgtacttcatgtgtcacatttaaattctccaggaagaaagggcttgtcaataaagtgtctttttaagtcacagatggcagtaaggctgtgctactcccaccttttctttctattcattgtctcctaatgtcatttattttctgaagtatctaagtagcaccaccactatccaagactgacagtctccatttatattcaatcataactcactagtgaagattaattggggaggagacaagtctgaattagaaatcaccaaagtagtattttaaaagaagtgcagatttattgcattcaattctagacctaattcagagacatggctagaactgttacgaaggaaatgtcttaaacggcctgatttaaagcatagagacaacccatttgtacattagtagaaagtaatgtgttttaaatctttaacaatggttttcttgagtagattaactaccgctttaaaaatcctatttatttatctcctacactaagtaaatttcaacacaacccttttctgaattttcacaaatactacaggagaggaatctaaattagaagctcgattatatatgttatttctgtttaaaaggcactaattaagctgctttgccctgtgagcactagaatttgggttggcacagtcatttcataatctgaactctaacacaattatttctggatgaaccattgccataaaatttaacaggctatattagctgttggttggcattgatgatctataaatactaacctttatctcttgatattttttctcattcttttttatggttaatttagaatttcactgattaggcatttgcttatataaagtgctttgttaagactcaaaacatttttaagcatgtttatgctgcaaagtgaatgagtgttgcaaagtttgacttagtgtagaaagattgtaagactagaagttacttttagaaaacctaaactatcttgtagaaaaattatctcacggtttttaaaaatggcgttcaaaattcagagagaacaattcaagcttgttgctagtggaaagttaacagtggtttagatcagttgtacacactgtgcaagatgtttatgtgctgacagcttgtgtgcctacctccacatcaattcggccattataccagctaattcttctatctaggattcataacataaaaatgtgcttcctctttctgagggaaagttgactatgggtagagaagagttgccgttatttcaccttgaagaataacaatataagctcatgtgcaatgaaatagcagacttattggaaatgattactagcttcttgaaagcaaagaagtatatattttttaacttcataaggatttagaagttgatcattcatcatccccttctgcactctgagtgctgaaccaactgaaaaagagatggaagcaagtgtcagacagaaatcaaaacagtagctcagactgtgtttctcttgtgacataggcccttcaaaccctactttttgaaagagtggctaggatacatgaagtcattacagtatcaactgcatacccacaacatttagaaaatataaaactccccagcccctacttcaaggttatgttctcagaaccagatatatagtgcagtctagccctgcatcatccagcacagtggttcctagccacatgtgactgttgagcactcgtaatatggctactgtgacagaggaattgaattttcattgtgttttaattaatttaaaattatatttaaaaactgattctcaattcactattggaagactttgaagtctacttgaaacaatttcaggtatgtgcatctactttttcaaccataagctacatggaacctaagtataaattagttatttctaattagaataattaattccattaaaatgaaaaggccaaattgagatatgctctcagtacaaaatacataagaattttgaagacaccgcccaagaaagagaatataaaatagcccatttataattgtttacatgttgaaagaattgtattttggatatacaggattaaataaaacacgaaaattgacttttaaaaattcatctgtttctttttacttctttaacacgattactagaaaatgtttaattacatatgcggctcacattgtatttctattagactcactctactagagtgtgatgtagattcaccctctagttggtgtgtaaaagtcatggtggagatttcattgtatctaggggaagaagaacaaactaatgaagggggagaaggagaaaaccttctgactcccaggaagccaactggtctgggccagtttgtgtctctgcatgacttctgagcctgaacttaagtggaagaaatctcccaccaagaagttacttacattgccaggtgtttgtttcttctcagacctaggattactgagctctgagtgtcatcttacctggatgcttcttctcctactcttgtttattaaaagctgttacttctctaggctttgattaacattaactattaaaattacagtgtaggctcggcatggtggctcacacctataatcccagcactttgggaggccaaagtggacagatcacgtgagatcaggagtttgagaccagtctggccaacatggtaaaacccggtctctactaaaaaaaaaataagtacaattgcaaaacaaataaataaataaatctgcagtgtaaaactctcttttactctctattttcctattgcaacataattcagctttccctgggtagccattccttaatcctaggtgagaaaaaatatatattaaagatgaaacatctactaatgcccagccctgcaaaaaacttatactcccatttctggtggaggcaacattgaaggttggctctctggtgtctaaaaagatgttctgcccatgtcgatttgaacacctattttttgtaaaaggccttgccctttccacatggactatgaaggacccacagaagtgaaactgtgtccccagtctaaactccctgggagaacctctcctgactcaataaagaattggtttttctgcccaagaacagagctctgcttgattagtttgaggtcgaggagaccacctggatcaccaagataaatgctttttcttgctaacccaacgcagaaacaggtacatttctcagttcttcaaccggccgaccctgctgcctcctggagcccatatagggtttcttgttcagccatagttctagaccttggctgcattttggaatcacctttctagtctcgagcataaaataaggcccagagcccaggccagactcactacatgagcattttcagctactaaggagaacttgaagaaaagaaattggccaagcagcggactcatgtgtgccctggcacttttcctatctcactaatcgcccttctcatatcataactcacccttctcatgaaaaaatagaatgaataaatgtggacggggaaatgccgaaacaccctcctcataacttgcacacgaatcctcctctatgttcgaaggcagggaaagagagaaaatggtaccaaagatagcctgtgtgcagtacttgaggcaaggctttgcatgtttcaagcgcccaatacttatctgttgacacaaagagtgccgtaattatgttagaattagtttggctttttttttttttctgctctagaaacattttgttcgtataagtcaaaaattagaaagaaagtttggaatttaatttcttatcaggcaatagccaagggaaaatatttctgttaaaggagtaatcatacagaacagctaaaattccaggaataataaaactcaggaaattttggggggagtggggtggttaggttttggaaaatatttgtcagtaatatttgaaaatccagatcttccttaaaagtctacagatttgagtgtacccctcacccaaggaaatctgtctcaagagacagaatcagtccatttttcagggttccccaggaaagtttgtcacagccagacataaatgtgatgaaaggcaggaaagggagagacagaggctgggacaaagaagatgacagactttattggtaacattaggccagaatgataaccataacccaggctgtgttttcaaagttgttgttgtaaactaaatgttttggtatatttgtcagaactttttatcttggttagtttaattaaaataaagtcggtagccaaaataaaattatgtaaaggttaatcaggatgtttcctgtattttttgacataaaccaaattaagtagttatttttctaacacatggaattcttacatttgtctccgtgcaagatgtatgttaatgttagttgttttactacatttgaaattcagtcttttaaaatgggttttctctgttctcctccaaggctatttgagcatctaaatatctacatattacatggctgttggcaaaagttttcaaatgctattcactcaatttgaaaaaaatttgcacttcttataaagctagtatgaatgtgactctaaaatctcaccaattggcactaatcaggttcatcatcaaaataaacctgataaatattaaaactaaattgttgagttggttttgtaatgtcaggattttcaagacaacaaatggccaagaacttggcgtcagaggaagtcctgctttcggttgattcttgatgctgattgagaacaggcctcctaagcactgatgggaatatttgcctctaagaagtacagcccatttaccacttagaagctaaagttcagaaataaaactctgacacaacaaaatatcaataaagccagatagagcactagaaaaattcgtaaatctctaatatgaatatacatctctaatacaaattacattcaagcaacagtgatttgcctcggctgcaagtaattatgtacctattgttaaaatagtgtgagtcacagcaagaacatggacaatatcaattcccttcagagactggactctgtgaagcctttccagttctaactacacagtacgatctttttaaaactatcagctttgcactcatttcagacccaagtatgttgaactggatgaggtattactttcaaggacaaggactggacgttaatcaaaatgaaaatactctttttttcttttttgagatggagtctcactctgttgcccaggctagagtgcagtggcgtgatcttggcttactgcaacctccacctcctgggtgcaagcaattctctgcctcagcctcctgagtatctgggatgacaggcgcctgccaccatgcccagctaacttttgtattcttagtagagacagggtttcatcatactggccaggctggtctccaattcctgacctcaggtgatccgcctgcctcggcctcccaaagtgctgggatgacaggcgtaagccactgcgcccggcctaatcaaaatgaaaatactttcaacatggaaataaagctttccagtgctaaagcttctgttttcttagagcaaaagagctccactaagaagaaaactgaatgttattgagatgttgtttaataagttcctggtatgtagattgaattgtgtcactgccaaagaagataggttgaattcttaactcctggaatctgtgaatgtgaccttatttgggagttgcagatgtaatcaagttcggatgaggtcatactgaagtaaagtgggccctaattcaatgactggtatcctcataagaaagacatgtagacatagccacacagggagggcgccaggtgaggacaaagttagagtctaaaagctacgtgtacaagccaagaggaattaaggattgctggcaactaccaggaactagtaagatgcatggaaatattctcccctagagacttcagagagagagcacagccctgctggcacctgcattttggacttttagtctccagaactgtgagaaaattaagttattttgtttgaagctacccagtttatggtaatttgtttcggcaaccctgggaaacttctatataaggctatgtcagaactcctcttatctcttaggaaaccaaagttctatccttaagcgaatataagatgtaagttcacagataactcagaatgtcctcccgcttctcaagaactagtcctgggtttgcattatccttataaatgccctaagatgattttttcaagcatatgttaccaagaagtagggaagtttcagcattaacaatacatagcttcgtaacaattagccatctgtttataatgctgttagggatcgacagcatctcaatggaagcagggaaaacaacagaaatatcatatctgccaagttctagtcatctgttatgttacatagtaatttgtcatctcatgagatcaccaaggagagaaaaaagccatgccgtgctacaaaataaactctgtaaagcaggtagtttaatagcaaattaatgatgtgctgacaagatcaagaccaaaaaaaaaaaaaaaaaacatgtcatattttctgcagtgcagctaataatgcaagtttgtaagctgtctcacaagaaggtagtatttattttttccaaggagctatttgaaaaccagagagttaacatattttaagacagttttcctcaatgtcagtttattttaaatattactagagttcagatattatcttgctatcactcttaatatccatcttaattatgggagtccctgtggtaaagtctaacctctttcaatctcatctcttgacttgatgattcatttcaaagaatgtgttagtacaatggggcttcttctcaagagcaaagtaactttgaataaaatttacaaaagtaaaagaaataaagcagatggcaaatattgcccacagaattggttatagtatcattatccattaagaaatgaattttgtacaatagatgatttaggtcttacttatctgtctctcataaatatgtatatatgcaatattaagatagatatactgatattgcaaactggcaataaaaaaggtggctttaatatttcgtatggtttggctctgtgtccacacccaaacctcatcctgaattgtaatttccatgtgtcaagggagggacctggtgggaggtgattgggtcatgggggcggtttcccccatgctgttctcaggatggtgagtgagttctcacaaaatctaatactttgaagggatttggagactgggtgcagtggctcatgcctgtaatctcaacactttggaaggccaaggtgggcagatcacctgaggtcaggagtttgagaccagcctgaacaacatgctgaaaccccatctctactaaaaatacaaaaattagctgggcacggtggtctgcgcctgtaatcccagtgttcaggaggctgaggcagaagaatcgtttggaccaaggaggtggagattgcagtgagcagagaacacaccactgcactccaacctgggcaacagagtgagactccgtctcaacaacaacaaaaaaaattagccatgtgtggtggtgggtgtctataatcccagctactcgggaagctgaggcatgagaatcacttgaacccaggaggcagaggttgtggtgagccgagatcacaccactgcactccagcctaggcaacagagtgagactctgtctcaaaaaaaaaaaaaagtgtttggcagtttcctccttgctctctctctctctttcctgccaccatgtaagacatgccttgattccccttctacttctgccatgactgtaaatttcctgatgcctcctcagccatgaggaactgggagtcaactaaacctctttctttataaattaccgagtctcaggtcattcatggcagtgtgaaaatgcactaatacaatatttggaaactctatgcaacaatacagggttcatatattgtccagcctgaattaaagtgctatgtgttatctctcctatcaaactatctttaagatgatgacaaagggatttcaggtgacaacttggaatgaaagatactgacccactgtttgctttcctgtagcttttcctcaagtggataaaaacaattacagctttttttcactagtctactaaattgaactcttaatatcaccccagctgcttttcttgtaggtgttcctttctatgtcaaccacacttctgtttgtgataaggattttcacctcatctgatgaaaagagcagtctactgtgagaaagaactaagcttctactcccaaagcacaagcagtttctgtcaaagcaggaatacaaatatggtcccttggaacctagcccattgcctttccaacataatggtggttattgagccatcagaccatgctttcagcagatacttgaacttccactgtgtatgaatcattatattagtgtaatagagctgtagagataaataagacctagcccatgcttataaatgcctcataacacaaaggacagagaaattatgcataaataaatgcaaaataaatgcagataaatctccatggctgttcagttacacaggcatccaacacatccattgagtatttaccacataccaactttgtcctaaagactgatgatgacacaaattgaaccagatttaggcaaccaccaatctcacaaagtttgcaatccaattagaagagaaaagaatttaaaacagccattgcattatagaatcattaatgcaatgaaaggaagattcccaagtactaagagaaggcaacgctgggacacctagcctaatctaaagggcccaaaataaatatccttaaagtggcatataaattaagacattaccaagtgtggtggctcatggctgtaatcccagcactttgggaggctgaggcatgaggatcgcttgaggtcaggagttcgagagcagcctgggcaacatggtaaaaccccatgtctaataaaaatataaaaattacctgggcatggtggtgtactcgggaggctaaggtggaagaattgttcgaacccaggaggcagaagttgcagtgagccaggatcgtgccattgcactccaacttgggcaatagagtgaaactccatctcacaaaaaaaaaaaaaaaaaaaaaaaattaagacacgaaggataggagttagttagccaatatggtattttgtggtaatgcagctataatctaatcaccgatgaaacagtattccagcaaaccacttcaaggaagctttgaaaaccgaccacatccttttggcctgtccatcatcaaaaaagataatagcccgacaaaccatgggttataaaatgcctgacacataactgtgattacagcattagaggtttaaaatgcaactaggaaaacttgaaaatataagcaccaatttcaaatcactagtcatttgcatcaatttcaaccattcccccgtactcctccaagcattctatttggcttgtgtcgtatccaagaccatccgaaatcacagaataaatttcctataacatgcatctttcgtgtgcataataatgcatactaacaatttacaatttgttataatgtcctataatgtacttctttattgcatctgtgtgactaaagagggcagtcgggagaaaatctaataggagaacttcctagggttgaggttcttcagcttaaaatctttataactgggaccccttacattagcactcagctttggccagtatgtctgagaccactcatatatatatacatatatacacacacacacatatacacatacacacacatatgattgttttgtcattgtaccttgtaaaaaggtatttgttaccaaaatgataaaaggaagtgaactttaaaaaatacatgtcttattactgtcatttggagtattcctcaaaccactgattgtatatgatatagctacctctaggaattcaagctcaagttattcacaacactaaagatacaaactgatttccaaaggtattatccaagaaattaaccgtttataagggaagcaaagtatctttccatttcttttatatttttatatatatatattttaagttctagggtacatgttcacaacgtgcaggtttgatacagaggtatacatatgccatgttggtttgctccacccatcaactcgtcatttattttaggtatttctcctaatgctattcctcccccaggcccccactccctgacaggccccagtgtgtgatgttccctgccctgtgtccaagtgttctcattgttcatttcccacctataagtgagaacatgtggtgtttggttttctgtccttgtgatagtttgctgagaatgatggtttccagcttctccacggccctgcaaagaacatgaactcatccttttttatgactgcgtagtattccatggggtatatatgccatattttcttaatccaatctatcattgatggacatttgggttggttccaagtctctgctattgtgaagagtgccacaataaacatacgtgtgcatgtgtctttacaggagcatgatttataatccttttggtatatacccagtaatgggatcactgggttaaatggtatttctagttctagatccttaaggaattaccgcactgtcttccacaatggttgaactaatttagactcccaccaacagtgtaaaagcatttctatttctccacatcctttccagcatctgttgtttcctgactttttaatgatcaccattctaactggtgtgagatggtatctcattgtagttttgatttgcatttctctgatggtcagtgatgatgagcattttttcatgtgtctgttggctgcagaaatatcttgttttgagaagtgtctgttaatatcctttgcccgctttttgatggggttgttttttttcttgtaaatttgtttcagttcttcgtagattctggatattagccctttgtcagatgggtagattgcaaaaattttctcccattctgtaggttgcctgttcactccaatgatagtttcttttgccatgcagaagctctttggtttaatcacatctgatttgtctattttggcttttgttgccattgcttttggtgttttagacatgaagtccttgcccatgcctatgtcctgaatggtattgcctaggttttcttctggggtttttatggtttcaggtctaacatttaagtctttaatccatcttgaattaatttttgtatatgatgtaaagaaaggatccagtttcagctttctacatatggctagccagttttcccagcaccatttattaaatagggaatcctttccccatttcttgtttttgtcaggtttgtcaaagatccaatggttatagatgtgtggtgttatttctgatgcctctgttctgttccattggtctatatatctgttttggcaccaataccatgctgttttggttactgtagccttgtagtatagtttgaagtcaggtagcatgatgcctccagttttggtcttttggcttaggattttcttggcaatgaggggtcttttttgcttccatatgaactttaaagtagttttttccaattctgtgaagaaagtcattggtagcttgatggggatggcattgaatctgtaaattaccttgggcagtatggccattttcatgatattgattcttcctatccatgagcatggaatgttcttccatttgtttgtgtcctcttttatttcattgagcagtgttttgtagttctccttgaagaggtccttcacatcccttgtaagttggattcctgggtattttattttctttgaagcaattgtgaatgggagttcactcatgatttggctctctgtttgtctgttattggtgtataggaatgcttgatttttgcacattgattttgtatcctgagactttgctgaagttgcttatcagcttaaggagatttggggctgagacgatagggttttctaaatatacaatcatgtcatctgcaaacagggacaatttgacttcctcttttcctaattgaatgccctttatttctttctcctgcctgattgccctggccataattcccaacactatgttgaataggagtgatgagagaagacatccttgtcttgtgccagttttcaaagggaatgcttccagtttttgcccattcagtatgatattggctgtgggtttgtcataaatagctcttattattttgagatacgttccatcaatacctagcttattgggagtttttagcaggaagggctgttgaattttgtcaaaggccttttctgcatctattgagattatcatgtgttttttgtcattgattctgtttatgtgatggattacatttattgatttgcatatgttgaaccagccttgcatcccagggatgaagctgacttgatcatggtggataagctttttgatatgctgctggattcggtttgccagtattttattgaagatttccccatcgatgcttaccagggatattggtctaaaattctctttttttgttgtctctctgccagccttcggtatcaggatcatgttggcctcataaagtgagttagggaggattccttctttttctattgattggaatagtttcagaaggaatgataccagctcctctttgtacctctggtagaattcggctgtgaatctgtctggttctggactttttttgattggtaggctattaattattgcctcaatttcagagcctgttattggtctattgagagattcaatttcttcctggtttagtgttgggagggtgtatgtgtccaggaatctatccatttcttctagattttctagtttatttgcgtagaagtgtttatagtattcgctaatgatagtttttatttctgtgggatcggtggtgatatcccctttataattttttattgcatctatttgattcttctctgttttcattagtcttgctagtggtctatcaattttgttgatcttttcaaaaaaccagctcctggtttcattgattttttgaagggtttttttgtgtctctatctctttcagttctgctctgatcttagttatttcttgccttctgctagcttttgaatgtgtttgctcttgcttctctagttcttttaattgtgatgttaggatgtcgattttagatctttcctgctttctcttgtgggcatttagtgctataaatttccctctatacactgctttaaatgtgtcccagagattctggtacgttgtgtctttgttctcattggtttcaaagaacatctttatttctgccttcatttcgtcatgtacccagtagtcattcaggagcaggttgttcagtttccatgtagttgtgtgattttgaatgagtttcttaatgctgagttctaaattgattgcactgtggtctgagagactgttgtcatttctgttcttttctatttgctgaggagtgttttacttccaattttgtggtcatttttagaataagtgtgatgtggtgctgagaaaaatgtgtattctgttgatttggggaggagagttctgtagatgtctattaagtctgcttaatgcagagctgagttcaagtcctggatatccttgttaaccttctgtctcattgatctgtctaatattgacagtagggtgttaaagtctcccattattattgtgtgggagtataagtctccttgtaggtctctaaggacttgctttgtgaatctgggtgctcctgttttggttgggtgcgtatatatttcggatagttagctcttctttttgaattgctccctttaccattatgaaatggccttctttgcctcttttgatctttgttggtttaaagtctgttttatcagagactaggattgcaacccctgttttttttttgttttttgttgttgttgttgttttgctttccatttgcttggtagatcttcctccatccctttattttgagcctatgtacgtctttgcatgtgagatgggtctcctgaatacagcacgctgataggtcttgactctttatccaatttgccaatatgtgtcttttaactggggcttttagcccatttacatttaaggttaatattgttatgtgtgaatttgaccctctcattattatgttagctgtttattttgctcattaattgatgcagtttcttcacagcatcgatggtctttaccacttggcatgtttttgtagtggatgataccggttgtttctttccatgtttagtgcttccttcaggagctcttgtagggcaggcctggtggtgacaaaatctctcagcatttgcttgtgtgtaaaggattttatttctgcttcacttatgaagcttattttggctggatatgaaattctgggttgaaaattcttttctttaagaacgttgaatattgaccccaactctcttctggcttttgggtttctgctgagagatccgctgtttgtctgatgggcttccctttgtgggtaacccgacctttctttctggctgcccttaatattttttatttcatttcaaccttggtgaatctgacggttatgtaccttggagtggctcttcttgaggagtatctttgtgatgttctctgtatttcctgaatttgaatgttgacctgccttgctaggttggggaagttctcctggataatatcctgaagagtgttttccaacttggttgtattctccccattacttttaggtacaccaatcaaacgtagatttggtcttttcacatagtcccatgtttcttggaggctttcttcatttctttttactctcttttctctaaccttgtcatctcactttatttcattaatttgatcttcagtcactaataacctttcttctacttgatcgaatcagctgttgaagattgtgcatgcatcacaaagttcgcgtgccatggttttcagctccatcaggtcattcaaggttttctccacactgtttattatagttagccattcgtctagccttttttcaaggtttttaacttccttgcaatgtgttagaacatgctcctttagctcagaagtttgttattatcaaccttctgaagcctacttctgtcagcttgtcaatgtcattctctgtccagctttgttctgttgctggcaaggagctgcaatcttttggaggagaagaggtgctctgatttttagaattttcggtttttctgctctggtttctccccatctttgtggttttatctacctttggtctatgtgatggtgacctacagatggggttttggtgtggatatcctttttgttgatgttgatgctattcctttctgtttgttagttttccgtctaatagtcaggtccctcagctgcagttctgttggagtttgctggtggtccactccagaccctgttttcttgggtatcaccagcagaggctgcaaaacagcaaatattgcagaacaacaaatattgctgcatgatccttcctctgggagcttcatcccagaggggtgcctgcctatatgaggtgtctgtcggcccatactgggaggtgtctcccagttaggctacacaggggtcagggacccacttgaggaggcagtctgtccattctcagagctcaaacactgtgctgggagaaccactgctctcttcagagctgtcagacagggatgtttaagtctgcagaagttgtctgctgccttttcttgagctatgccctgcccacagaggtggagtctatagaggcagtaggccttgctgagctgtggtgggctctacccagttcgagcttcctggccacttcgtttacctactcaagcctcagcaatggtggacaccccacccacagccaggctgctgccttgcagtttgatctcagactgctgcgctagcagtgagcaaggctccatgggcatgggaccctccaagccaggcatgggaaaggttctccttgtctgccggttgctaagaccttgggaaaagtgcagtatttggtcagaagtgtcctatttttccaggtacagtctgtcacggcttcccttggctaggaaagggaaatcccctgaccccttgcacttcccaggtgaggcaacgcctgccctacttcagctcaccctccatgggctgcacccactgtccaatcagtcccagtgcgatgaaccaggtacttcagttggaaatgcagaaatcatccatcttctgcatcgatcacactgggtgctgcggaccagaactgttcctcttcggccgtcttggaatggagctctatctttccatttcaatgcagccactttagcagttctcttaaagctgaaaatatatagaaaaagataaaacctttcaacagctacagtgatcctgaagtaaattactgtgtatatgacacagtgcattatcaaattgttgctgcatcagcatgtcattttcaaaatgaaaacaagtctattaaagtgcatatcgaaggtataaagtaggatgatagtgtatagtttgatcatgagatattgcttgcagtgtaagtttcatagaagaaaaatggtttgagaaaatggatcaaagggaaatctccaagttgacaacaatgtgttaagagaatgagaatttcaaagtacaactactgaaaaagccaaatttatgcagacaaagtgaaaaagaaatgaatcaaccctggaagagggagaatcagcacatcaccgtcaaggaaaacaagtacaagaataaatggatgttaatttcagctcacaagacagtagtaatttcaaaataactaaggaagggaagtgaaaaaataaactgcagtgtcataactgactcttgatccggagggatgtataagtgtccctgaataatgactgtagttgtggttttgcttttctagcctccttgcttgataaaaaagcctatggaatgatgtaaaacatagattgcagataataagtttgtgccaaggattggctggtttagctcaatttcatatcaacttacaatttaacctagagtattttacatcatctcatcagtttatccatttaaattgattatcttgatcttcttttattttttaagatcatccagtaagtatgtattcagcatctaacctgtactaaatattttgctaaggttgagggagacattaaactcacaacactcctataagatggacattattattacttccatttaacaggtgaatgactaaggcaaagtcatattagatgcccaaggtaacacagctagtaaatggcagaattgttgtgttagttcaggtcctccaagaagcagatgccaagacaagaatatatgtgcaagagatttatggtattgatctatgttgaaaatttggtgaggaagttgcaggagcctaactgagagagactcaggccataacgctggtctgaccctatggaggaaagagggaaggaaggaagattgggtaggaaatttcttagtctctggtgcagttctagaaaattttggcaaggctcatgggaagtccttgagctaaagtagcccatatgaggagccccacatcttgcagaaatgggcctgcctgagtatctctccctgctcagcattgcctggggcagcccatggaaagggtggcccagaaattgatgtggtggtggatcccaagcagctgaccatctgtcattcacactcctgcaccaggaagttgagaggccatgttactggtcccacagctgagatctcaacccataaaccttgtggcagagaaaacatgctcaaccccaatgccaaggcaatcctggcattcaacataaaatcagagaatgcaaatctttatatgccgcaattcataaattctttgcatttttttagtctgcttctgcttatatcagagatagaacatccaaggccaacaatacacttcttgtccttgagaacaggtggaagtcacctaggaaaatggaacataaggaggatgggatcctcttgtggcatctgttgtgaccctaggagagacattgtggatggcgaggggatacaaattctggcttacctccgtggtctgaggatagggggatcctttcagagtccctcctatccctcaggctaaccaagcatctccccctaccctcaactattacctggtcccaggtaagaaaggaaggaggctttccagcatagccttacttttggctgggcttggcaaagaaggtgtttggagtaattatggcccctcggtcacccatgaactcagaccaaccatcactggcctcccttccagatgatctctatttgagcagtttggtaatattttggaaagtacatttcactcatttaatgggaaaataatttaaatatgatttagatatgtattgaaagaatttactagatattttaaccatgtgacttgttgttgttgctatttgtattaggggaaagatgccagggaaattaggtaactagtctaaagtcttgcaaaagtaggcaggatttgaacttaagtctgtctgacctgaaggccacattccttctcctccatggccccctgccccagatattttactgggctcgggctttacaaaatgcttgtacatgtgctatttcatttgaactgtaatattagctactattttccagtccagtattatgggacttaaagacgtcagtgccagaaggtctattggttcttttcccctcctgggactcctcctctgcctcagttgccctcattggggtatcagcccccactacagccattacaaccggcttggcacgtccacaggggctgctgcccactgaagtgggtacaatttctttatccacccattcttctccattcctttctcttttttttttttttgcccctttttttaaccctatcttcattcttgagttcattcctgccctattactcctccaaagcacacatgctatccactcttcttcactttgagactatgtgagtcgtggccgaatagttcgggaatttattttgcacaatttgcacaggccagctcctctcacatctgcttcaatgatctctgtctttatcttcccagttctggtgtctttccttcagctctggatttcttgctttggttggagccactacctcgacatgctcctgggtaatgcttttttcgtacgtgttttaacttttattcacatgagtgaaattgatttttaaattaccactgtccctagcaggaaaaagccagtggcagagccagaaagagaatctactcctccttggcccaccctacattctttgactatcacaaatgccctgtggagaaagagaaacctgcccaccctgtgtgttccaatttactgaaataacatataaggcatgatttggttattttggaattcctcaatttctgatgttatcataccacagaattttgggactatttatcagttgagtgttaacatatcagatccaactttgtaattcttctttttagcagttgattatatttttgaagcccacaagcaccaatttcagggaaaatataagcctaaaatcattcactagaaaactacagaaccgaataggagagtaaatattatttaacttatgcttatgatttgatgtctttatttcttttttattgtgaagcagaattacctttgcctagcattctactgactcaccagtctaaccaatctaccttctgagggtggcagcaagatgggcaaatctggagatgagctctttcaacaaataaacatcatgatagattcctggaaggatttttggtgttttggccgtaactttctagttcaaattgctcattcatgaatcgtcacaaaatgacattcaaaaagaaagtaaatcttgattcaattcattatactatgaagcttttgacttaagaattagaaaaaaaacctttatccaacaaacacccttttttgggggcgtagattacttcctcaattccatcttaccacagaatcaaatattcccaagtatcaagtatccttctcatgtgaaattcttgctataaatgccaaacaagaggaaaaaagaaaaatgtacaaataattaaaacacaaatatatagcatgttagtaggcattgtgtgaatgaaaaaatagttcatgtctctttagatttatgcacagataagagataccattcaatacatgtgctgatcaaagcctaaatatgaacattcaataaagtaaaagtgctaacaaaaatttgagtttggcattaggtcaccaataatgttaattgattgtacttatacataataaaagctaacattttaaatctatcctgatagacaggaataggaatccacgctccagcttgggatcaagaaaactaaaattagtaacactaactggactccttaccactaaggagctctaaccagaaacgtttgttaaaataaaaagatagggagtgtatactagtatgcctttggacttagctaagaaaaatgtaaaatataaaattgtattagtccattctcattctgctaataaggacatacctaagactgggtaatttataaaggaaagaggtttaatggactcacagatctacatggctggggaggcctcacaatcatggcagaacacaaaggaagggcaaaggcatgtcttacatggcagcaggcaagagagcatgtgcagaggaactgccctttataaaaccagccaatcttgtgagacttattcactatcacaggaacagcacaggaaaaacccacccccatgatttaattagctcccacagggtccctcccacaacacatggggattatgggagctacaattcaagatgagatttgggtggggacacagccaaactatatcattctgcccctggctcctcccaaatctcatgtcctcacatttcaaagccaaccatgcctttccaacggacctccaaagtcttagctcattccagcattaactcaaaagtccaaaatctcatccgagacaaggcaagtcccttctgcctatgagcctgtaaaatcaaaagcaagttagttccttcctagattcaaggagggtataggcattgggtaaatacacccattccaaatgggagaaattggccaaaacaaaggggctacaggctccatgcaagtccaaaattcaacagggcagtcattaaaccttaaagttccaaaatgatctcctttgactccatgactcacatccaggtcacaatgatgccaaaggttggctcacacagccttgggcagctctgcctctgtggctttgcagggtatagacccccatctcagctgctttcatgggctggcgttgaacgtctacagcatttccaggctcacggtgcaagctctcagtggatctaccattctggggtctggaggacggtgacgctcttctcacagctccactatgcagtgccccagtgggaactctgtgtggggggttccaaccccacatttcccttctgcactgacctaggagaggttctccatgaggggcctgtgcctgcagcaaacttcttcctggacatccaggcatttccatacattctctgaaatctaggtggaggttcccaaacctcaattcttgacttctgtgttcctgcagactcaaaaccatgtggaagctgccaaagcttggggtttgtgccctctgaagccacggctcaagctgtactttggctccttttagccatggctggagcagcttggacacagagcaccaagtccctaggctgcacacagcaggggggccctgggcccagcccatgaaaccatttttccctcctaggcctctgggccagtgatgggaagggctgccatgaaggtttctgatatgtcctggagacattttccctgttgtcttggtgtttaacattcagctttgtttgtttgtttatgcaaattcctgcagtaggcttgaatttctccccataaaatgggtttttcttttttattgcatcatcaggctgcaaattttccaaacttctatgctctgcttcatcttgaatgctttgctgcttagaaattcgttctgccagataccctaaattatctcactcaagttcaaagttccgcagatctctagggcaggggcaaaatgctgccagtctctttgcatatcaagagtgacctttcctccagttcccaacaagttccttatctccatctgagaccacctcagcctagactttgttgtccatatcactatcagcattttggtcaaagccatttcacaagtctctaggaagttccaaactttcctacatcgtcctgtcttcttctgagccttccaaactgttccaacctctgcctgttacccagttccaaagttgctttcacatttttaggtatctttatatcagtacaccatttcccggtaccaatttactgtatttgtttgttctcatgctgctaataagtacatacccaagactgggtaatttataaaggaaagaggtttaatggacttacacttccacatggctgggaaggcctcacaatcacagtggaagggaaaggaggagcaaagtcatgtctttccgggcaggcaagagattgtgtacaggggaactgccctttataaaatcaacagatcgtgtgagacttattcactatcatgagaacagcccaggaaaaacccagccccatgattcaattacctcccaccaggtccctcccacaacacatggggattatgggagctacaattcaagatgagatttgggtggagatagagccaaaccatatcaaaaatgcttccagtgaatagacctggggaaaataaaacaaagtaatttttaaaaatgcttaacatgaccaggcacaatggctcataccgtaatcacagcactttgggaggccaaggtagtaggataccttgagcccatgagttcaaggccagcctgggcaacatagtgagactctgtctctacaaaaataataaaaataaaataaataattatggttttaaaaatgcttaacataaccctttctacttcagcaggagggatagatttacattttgggatgttttcagcatcagattactctgggtgaccctaccttcagaagcagataaaagtggtaacaacacaattaaggagtattcttcagtgaataaaatatttgagagtacagaggtaaagaataaaagttctgtggtcccatctagggctaaatgtcaacaccataaaaatcatactgaatcactctgatcctatcactgcagaactgaaaattattccatttattttatacacattgggacccaaataagttccaacttatataaaagaatgaaaagtaaatcctgacaacctaccggaagagaacactctgccccgtgctttccattctccttcgaatgcgtgagtgtctctccctgtctctctgtcctgctctctcacgtcactttcttttctccatctttatttcactcttctttggtgtctcctttgcttactgacatgtattgggcttttttcttatgcattgtcctcctcttattgcttattattattagtgctgctgtgcgaaaagttttgtttctttttttatcatttcaaaagcagaggagaaaaacgtttaaatgtatattgctcagccaaaataatgtttatttgcatgggaacttcgatttgtgtgtgtttgtgtggtataccagagagaatggggacagcaatttttcctattgtagaacgagaaaaggaccaacccctcttcaataacaccagataatgggtaaagtggctgaagttagttattatgtgctttaccaaaccttggaatcaaattgtaatacaaatattattgttattccttcctttccctccacatttttttttaaatagcagttagggggagtgatattcccctactttgctctgtttggtcaatctctggctcatcataaggtagagacgatgttttctaggaagcctgaacgtagggtgcttattattggtgtgatgtttagtttgttaattcccaccagcctgagaccaccaggagcacaccacagaaaggtgggtctgtgggcttgcaagaacaggaacattagaggggggtgtgcactgtggggaactacggggcatccttgtaagggaatgtggagaggaggatattataggattggggctggtgtcgggtgatttcagggagtgaagatttgttgtggattgggtggtgctcaggaatggatgcaaattgatagcaggagggcccacgtggggctgtttgtcattgggaaaaaagtggtagccagtcaggttagccagatgagggagtttttcggttatttttgtggccacacatggttttggtgttcagacacaacgaaggcttttttgtgttgtttggccatgatcatggagtgaacctgtttgattattgctgatagtctatggaattgtattatgttcaggagtctagctgttacctcagtctggctggtacctgcaaactgccagctgccagagcctttttgtttttccttctttctcaggtctcagagtaaatgttaaccaatcggtcagtccatccatgtgtaatagctgctatgcccagcactgagctaaacattatgaacaccatatggggactttctcattaataaaacacccacatttaaaaagtaatggaaaagaacataaaagaactagagaatacttaactaatatttgaaaccgaagtaaatattctatcactcatccattttgtgccctagaaggttctaaatgaaaagttttggtaaaacccttcatttatttcatagctaagagaaagggtactgtttgaaaattaatttttataaataattgaattgttcctcctcctagataagctcaagacactttgttaaatgaacacctgacaaaggctttcattttttctaattacaaattagagatactagctgggttgtgtctggttttttttcattgtttttgtttgtttgtttatctttgttgttgttgttttttacctcttgcagcagttgaaatgcatgtggtctttggttctgtatatttaagctctagtttattacttctaatctttaaaagatattaaatcatttaaattggcagacaccagtgtttgctggctgctcgaatattaccatttaataccctacattggagaattaaagcatggtgccctgctataggcaaagtttagaagagtcctgcctgtcatcttgatggtttccaacactgagttttctaattactatattttggtagggcgaaactgagtatgctgatggtttttgcagctatggtagtaacatttttccagccatctttaggtatgtttttcagtggaaagtttagcattggaagtttagggtttttttttttttctttttcttttagtggagtgatgtataggtattctattttattactcattggaaaattatctatttgtacagtgcctaaaacagctgaacacctagtaattgttcagtaaatgatgatgatgatgatagtgatgatgatgatgattttctcttcaaattaaggacaatgtcaaattaattcttgttctctagcttctaatacagtatttgactcagcctccctaccagccacttgactttgctaattacttatgttgtaatcatttgatagtaatttgaattattctttttttttgagatgtctttgtattccttgaaagaaagttattgtttgttatatatcaaaaatttttagcaatctttagggtcttttttctctgaaaactcaagtttatttttgtctttttatcaaatacttttatagatttaggaaataacttattctagtttaataaattatacttggcccgttattgttactccctaatctttctttgtttctgatggggagaaaggatccttttagattctttttaagtcactctgatttcattctggaaagaataaggcaacatacatcaaatccttttgagaatattcaacatgagatagttttcttttaagtctgacagtggcaggccataatactactgaataaattcttaccaaactgaagcttctgggctcagtttcaatgttttatttagtattgttctcaccagctttcttctgacagggctcaatgaagatgttagttaatattcttgcacattgcatttggatgggtttgctctttttggtactgactctgttacggttttcacaatgacacacacttctgttggtttattactaaccatagttgttattgaagagaacctctctttcggcctcagtgatgtagtaaacggtaattttgcaatccttacaaattcacccttatacaatgtatggtacatttctgaacatggtaatttttaagtgctttcaacttgcaaagtagcaaattgatacacaggggatttccgacagcttcttctccagactgaatgtcactcatgggattgtgattccatgtgaaataaggcaacattggccggaggagctgccatctggactttgacgacgaaggcatcatttacacagggctggcattcagagccagggtcacaaagcagctctttccaggagcaaaatgaagttgtcaagcaagtatttgctctgactctgccaggcaccattcagatatgacaaacttgccttcctctttttattacagcttactaattctggagaaagatggaaatttttttttttaatgcgtgctcttccaaaggtcaaaacaattttaaacaagggcaggcacagtcctgcaataaaaattcagcaatctagttgtgcaataagtccgtgtaggggctgagggaagtgtcatgtttacctctctggaaagggcactgtaatcaaaagactgatggcaagaggagctttgaatttgttgttctatttctcccacatctgcatgaaattgtgtctttgaaactatatattatggagatgagtgatactggagagaaacacatgctctgaagtaaacagaaaaatacagcagcataataaaatgctttgcccacttttacagcctctgtggtggccatgaaataggagatgccaactgatggggatgtgagtggagctgtttgaggggtggatttttccccattactacacatagatgcttgcatctttccctaactgtgtatttccttaggtgggtaatgacagtcagtggaaaagccagtgcctgctgttcaaacacagtgtggaaaaaatgaaattgaaaacagtggtgatgagatccagttctccaatattcctctcctagacagactaaaacctttcttctcccgcagcgttagcgctcactctggtcctctcagctgcaaagcagatggatttctttgagaagtggtcagaatttccttgattcaggagctggacctcacgccctcctctagggctccatcatcaccacacaggcacacggccacacctgagtcccatacacagagaagggtggtcatggacaaaagaaacagtggacaaagttttgtgtatgacaattcctggtggctccaatagcaggatggatggatttgggctattaacagaggtccaaaatcccaaaaagtgaccacatgtagatgagacagtcatgacttttatgtgcatttgaattgggcttgagatacctaagtggggatgcctaatcgacagttggatatgtgagtctgagtctcagaggaaagagctgatttaaacgtacaaatgagtgagtcctgtgtctactgaaggcctgaatatggatgagacagcacagaaagcagaagaagagggagcatagaaagacgggacttggaaagtgccaactttttcattgtttgagttaaaaaaaaaaaaagttaagactaacagaaatagcaaccagagaagtaggagaaatcaggaccagctctcgggacataggttaagtgtaaagactgttccaagacaaaggaatgacagggacaatattgagcatcaaatgctgctgagaggtctggtaaaataaaaaatgcaaagatctattggatataatgaaatggaaggaggagtagaccttaacaaagaccattttcatgtgatgattggagttgggtgtgtgtgtgtgtgtgtgtgtgtgtgtgtgtgtgtgtgtttccaagtaagataatcagtcttagatgccagtgggaggaatcctaagagaaataaagaataaataataatgtacatctcctgagaagatggagaaagggtagaaccctaccataagaccaggaagtggccagaggtaggaggaaaaactgctgtaagagacaggagaagatggtattcctacagacagaatggtgaggcatttctctctgatatcctgtatttttccatgaatttaaaaatgagatcagttgttgaagaatgaaaaggaagttcctgagagcatagacacaaatagatacatgtgttttgttgaaaggccaaagagtgaaaccattggaattgagtatatgtagcaccaccaaatgcagaaatctattaaattgttaagaatatggaactggagttcacaggagggagagagagagtgggactagacttatgtggcattagcattaccaaaggtgtgtattgtagtcatgggactgaattcatgaagtcatttaatatatactgaattattatgaatcctagtagctgcagagaatatatactgagttattgttatgaacctttgtagctgcaaagataaagtgagatggcttccacccgctgagtagtcgtcggtctagaaagaagctgacatttacacaggaaataggcagtgtgaccgaggctccaataagcaggacaaggttttataaatgtttgtaagaaaatgcacctctctttgctagaagaatagaatagttagaataggaaaacaatgtttgtatctatacataaagaaaaagcaggccagcaccgtggctcacgcctgtaatcccagcactttgggaggccgaggctggcagatcacctgaggtcatgagtttgagaccagcctggccaacaacggtgaaaccccgtctctattaaaaatacaaaaattagccaggcctggtgatgggtgcctgtagtctcagctactcagaaggctgaggtaggagcatcgcttgaacctgggaagcggaggttgcagtgagccaagattaagccactgcactccagcctgggcgacagaatgagacttcatccacccctcatccctaccaagaaaagaaaaaacagtggcaaacttgatgaagaaatgagaagaatatttctgttaccgagaagaggtgtgaataatgttgttacaatatatgcaatgtaaagaaaatagacatgtggcaatataatccaattaggtcacttctgaaaacataatcagaaaaaaaaatcatagaatcatgaaataataaagccagaaacagagatcatcaaagtccatgccccatgttagacagcaggaaagagcctgaggaagaaatggaacgttatgatcataatggaggtggaatagagtccagatctcctggctccaatttcagtgatcacctcactcactgatctctatttcacagccactcttgcactggctggaatatgcaggatctgtaatatccttgggaaggaacagaattctctggggtccactgtcaaatagtggacatctgaatcagctgcttcaggtgaggtggtgctcagccccctgcctctgtccacagatagagaacagagttactttgtgagcctctaggctgtcaacattacccttgcagatctgtaggatttatgctatgctggagacataactgccgacctagtgggaccagagtggaggtaggaaggcttccgagtctctctttgtaaagcctgtgactacgagccaggctttaacagaatccctgctttactccctttttgtgggttatgccatgtacctctatagtctcccaagaatctgtcaagatatcagcttttattactcattaccctaaacctaaagaagacagacaggacagaacccaggaaatccaataagtggatttcccagaaatgaaagtgcatagaacctagaaatccttatatgtgaattttcttgtgaataaaaagtataatagaaaaacaatttggtttgacaaatatatacagaaatcttttgtttgtgtgtatgtgtgtttatttaagattcgcctgcttttgtaaatgtaatcagctacatacaatttttaaatttctcacttccgtaaaattgtctttccttgggtcatgattctgaacactgatataactgtacagcatgatagatagggtaggtgtagaaaattgtactgaattgtcattgagtgttggctataccagggtctcccagaatatagaaagccttgtgctagttagaaaatgggctcctcttctctgcaggccaattagtttcagccagcctcatgagctgactgcatactgaagtcagccccaaatcctgccctcccaaatcaacctgcactaccatatcttaagagtagactgtcaaaacaagtccctggtttactcttttttttgagacagtgtaagacacaagtagattattgagcttcctgaaaagatagattcagagtaattaaaatttgattttaatgctgctaagaaaagaatagagatgtgatataaagttatgacacaaggaatacaaataagattatcacttatggatgatggctgtttgaaagataagcccaattatgaacaccaatacagattctgcaaatgtatgttcagagatggttatataagtggcataattgctgtaccttttacatagaaaaattgcagctattctttaatcaactgacactgggagaaactgattaggtgtgataaagttgcctcaggtgaaatccaatttcaactgatagactgaggcataaagaaaggaaaaaatacaccgaaacaccagaattcaaaatgtgcgcatgatttttaaaatttattttctcttttttctttttttaaaaatgtgtttagatatgaaaaaagaaatagaataatgacttgaattcgtgcatctgaaaaatgtttattaaccacctaactatggacaggtgctatttatcagaaaccaaaacaacagctcaactctactggatcataaactctagtgggaggggacaaaataaacaataaacaaaacagtatctaatattagaggtggataaatgcaaatagataaataaagtaggataagggttatggagtgaagcaaagatgctctttggaggttattaagtgaaagccagcctaacaaaatggcatttgaagaacatctaaggaaggaggatgaaaggtccttgaggatattaaggaaagagaatttcaggtggcaaaaatagtccctgccaagccctaaagtgggaatgtgcttgggtgtttaaggagcagcaagatggcagaccggctggaacagcgtgagcaaaagccttgaacaatgaaagaggtcagtgataaataaggaattcattcttcacagaaaatggggcgatgcatccaggcaggttataaagattaagagttgaaatcagagaggcaggtggttttgatgttttgagatttgcttcctaataggcatcttaatcaaattattcatccagagttgcaaagcagcaataaccaaaaacatatctgaatattgagtaatttgtcacattcattacaatcaaactgatatcatttgcctcgccagaaaaaaaaaaaaatgactaattgacataatgtgaagagctttgaagaattgcatttaataccagcaggttaatcaaaaggctaacgaaacaagttttagttaaatacatacaaggaaaaatgtattctgtgtctttcctgctgttgtcaggaaaaaaagaataagggcaaattttagtgatttcactgtttatatgtgtcccttttacccacttgaaaaatctgccacttattattgttattgaattttccgtcatcttactgctcttctgtgagattggaggactttgaatttgtgccacttttattaactgcttgtgccatcgagaaaggctttagcatcttagtttcctgggaggaagaccgggtaatggatgaataatgtgtgactctgccagtttgatgtgttataaacaaaaaaaggatttgtgcccccactaaatagcaggcttgatatgagacctcaggttttgagctgcataagcagcgtcttgctctgctgttgaagaatggatgcatttttcagatagtaagtaacacatgactgtctggagagtaacaagtattgggttggtgcaaaagtaattgcagtttttgatgttactttcaatggtaaaaaccgcagttacttttgcactgacctaatagggttaaaggtcaaggctaagtattttaatgtcatcaattttattttctttcttaatgtgttaaatagtagaaaagaagaggccaggtcagaaagtctcaatattaaggcttatttgtctcccttgtccttttctggactctcctggtcgtgtcttcatcaaattgggttaagaaaccaaactcagcttgagatattctccaaggcaatgtttatgtggagttggttcaggccccagcacgttgggaagaagtagtaaatatcataatagtgattgtagttattgatcagtattggtccaatcatcagagctttgatctttccttctttgtcaatttcttttacttttgactacagattcattcagaactccaccccccgccaccccgccccatcttgcagaagccacactttctccttcatcaccctttggctggtctgtctctctctccttatgttcagaaggcttttctgttttgatcattcatgtttgctttcttatatcaccttaacctcttaaagcttgatcacctgaaacatgagtctgccgctcagatgattctaatcctcaaatctgatgatgtcggccaacctttacccttggaacactggaacatttacctttctgaaacactcaccgctcgtttacctgctagaagctggagtacagaatcagtgtccaggtggaactcccagtctgtagggaagatgagcacataaagtaactgcaacacaatacatgaatcagaggaagaaatgcaataactaagttctgcatgaactgtggcttaacacaaatagggaacaaatactagtggctgtgggaaatgagaatgaaagcagatttcagagaagtaacattcttcaaatcacgttgcctagacccttcccattttgtagctgctttcctaaattctttcttcctctcctgttgctgcagcaccctaagaggtggggccttagctagccatgtgccccattccacagactgtcccatgctcaggcatcagttgtcactgtggatgactcacagaattaaagatgcggttctggctgggcgcagtggctcacgcctgtaatcctagcactttgggaggccaagacgggtggattgcttgaggctaggcattcaaaagcagcctggccaacatggtgaaaccctgtctctaataaaaatacaaaaaaattatccaggtgtggtggcaggcacctgtaatcccagctacttgggaggctgaggcaggagaatcgcttgaacccaggaggcagaggttgcagtgagccaagatcatgccactgcactgaagcctgggcaacaagagggaaactccatctcaaaaaaaaaaaaaaaaaaaaaaaaaaaagatttggttgtaatctctctctctcttgaagtcgtaagtcccatctcttgtacatcctcatttccaagttgctatgtcagagggcttctcaaccagggtgctactggcatttgaggtgtgacatttattgtgcagaactatctaacacattgtaagacattcagctttcatgggacctgaggcactacatatcagtggcaccttacacatgtttccgaatcatacctgaggaggtagtgccagccccagttgagacccactggcacatcaaattcaccctctataaaattaaactgaaaaagtgttcatttcccccaaaattaacactctcctactgacatttctttcaaaatgttcagatttgcgtaatcgtgaaaccaagcatttaccactagctgatccatcaggtcaacacatcctactaatgtccttttatagtatgttttccctctgtctgttaggcagaatgtcacatccatgatactccaagtctttatcacctaatttgtagaatagttcctctatttactgttgcctttcctttatgtcacattgtataataaaatatcaccttgaccatgcctctcccttgctttaaaacctacagtaacagacttcgactatacaattaaggccaaatagatacaacaaaagtgctcccccataaacatttttaaaatgcataaggccaggcgtggtggctcacgcctgtaatcccagcactttgggaggctgaggtgggtggatcacctgtggtcaggagttcgagaccagcttggccaacatggtgaaaccccatctctactaaaatacaaaaattagccagatgtggtggcaggcacctgttatcccagctactcaggaggctgatgcaggagaattgcttggacccaggaggtggagattgcagtgagctgagatcatgctattgcactccagcctgagggacaagagcaagacttcgtctcaaaaaaattaaaaataaaaataatttttaaaatccttttaaatgtatgattgagcatgcaagaaattgaggaagatccttgaggcctaaaatgaagaaaaatcatgaaccaaggttataaatgaatgccaaagccagaagctgacctaaaggcttctgtcagttccatgcaaccagcagcttttctttcagtggctatatgaggaagaagggtccatgccaagtaataaattatatcaaatatccctgtatggaaaacaaaatccagggggttagactctcaatgaaaaacaaaactgaaaatggaaaaatccactctacaaaagaagataatgtaaaaattttgattatctgaactttagctcagagtacaaagaagaaattatcccttgaagctatgtaatagaaagccagttctgatgcatgtttacagcctaacttcacagcatttgaatggttggagaaaactcaagctgaaaatatattttaaagaggtcccagattggtaatgtctccatgtatctgagaaaagcaaatgcagatgatctgagagagacataccttctactgaacctcacaggattctcacagacatatttccaagaaacatgatctcaaaagaaaaaataatcaccaaatgtatggggaaacaagatactgtaattgtgaatcaatagagataactaatagcattttcagtcctacagaatcttcaggtattgaaattattggattgaaaaaaattttaaagagaaaagtggatatactattaaaaataatgggtaacatttgaaaaagaaccaaataaacattacaggaataaaaacataatagataaaattaaaagcttaatgttagagataaatagcagtttctacccagctaaagtaggaacaatgaaattaaaaatagattctgaagaaatttcccagaaatctgcccagtgagagttgtcaaatatgaaaaataaaatattaaaagcaaggagattagatcacaaccaatcaatacatctctaattggagttgtgaaagaagagataagagtggtgaggccttattttggtgaatgatggctaaaaattgaccagaaccaaaaaaacatgcaaattaagattcagattaaggcatcatagtggatgtaagccagaatgaaagcaatccccagctagacagaaattacagattatttacaaaagaattgaaattaaactgaccattgacttcttgacaatggaaccctgaagaaacaaactattgtgagaaaataaccattgaccttgaatatgccacccagaaaaaaacacatatataaagtctaaataaagactttttaggacaaaataatgataacatactaccctctgaccctagagaaaaaaagatctcataagaatagtctgagatagaaaaaagagggaacaaagaaaatagtaaaatgtcagtaaatctatgcaaacattgacaatattgagcaataaactttaatttgtgatatttaaggaaaacaagatgaagctaaaaaatagatgaaataccttatatgtaaggaacagaaacaagctataaaattgctgtattgtttaggaagagaataaatatactatgttgagacactgttaagttaaatatgaaatttaaactttctagggtatctactaaaagaatgatatttaagagaatgcaaaattctaaaccagtagaaaatatatggaatgaagaaaaactatcaattcagaaggaagaaaaaatacttaaacattagtaacaataaaaagcaaacaagagagaaaaaaaggtacaaatatttggaaataagtccaagtcagttatcacaataaatagactagactctccagttaaaagataattttagacaattaaaaagaaaaactatgtgctgtacacaagagatattaaaaacattaaggacaccacaaagtctgaaagaaagatgatagaaaacaaggccaggagattacaaattccaaaaagctattgtgagcctattgatacgaatgcaaatgaaagagaaaaaaaaattacaattcagagcattacaatagcataaaaatttccaaattactgaaaatacctaatgctaaacttgggaagattgaaagatatagtattatagaagaagcttttaatattgatgtctcagtaattataggtcagaagcctttaaaaatcattaagtgtacagagcagcagtatccaaaagaactttctgaggtgatcaaaatattttctgtacaatatggtagccattagcacatatagctagtgagactgaaaaactaaattttaaatagctgcgtgtggctattggttacctactgggcaacccagataggattaaatagcataattaataactgtgagtcaatgcacacatagtactattagaaaataaatattttttcaagcacatgtaaaatgtttttgaatattgaccacagactcgattctttaaaataaatctcaacaaatttcaggttattggtatcataaatcctgttttctatgaccaattaaattttaaaaatcagctaaaaagacacttttacaaaaaaagcttaaagcaaaacatataattagacattttaaaaatacttctaaataatccctgcactgtgggagactgaggcgggcaaatcacgaggtcaggaattcaagaccagcctgaccaatgtggtgaaaccccgtctctactaaaaataataataatcaaaattagtgcatattatcaaataatgatgacagcataattcaaaacttgagggatattcctaaagtggtattttgatagaatttatagtcttatgtgtatagtaaaagcttagaaaggctgaaaattattgatccaagcatccatcttaagatattagacaaagaagggaattcttgtacacttttggtggggatgtaaattaggacgaccattatgagaaacagcatagaagttcctcaaaaaataaaaatagaactcccatatgatccagccatctctctacctgctatgtattttttaaaactgaaatcagtatgtcaaagaggtatctgcattcccatgttcattgcagcattattgatagtagcccagatgtggaatcaacccaagcgtccatgaatggatgaatggataaagagaaagcaggatttaaacacagtgatttctggaacacagaagaacatagaatacattatgttgagtgaaatgagctaggcacagaaagacaaataccacatcatctcacttatatatggaatttttaaaagttgcactcatagaattagagagttgaatggtggttaccagaggctagggaatgggaggttgcagagttgttgatcaaaggatataaaattttagttagataggaggaataagttcaagagatctattgtacaacatgatcattatagttaatacagtgcattgcattttgaatattgctgagagtacacaaaaaatgataagtacgtgaggtaatgcgtatgttcattagctccactgagccatttcacagtgcatacatatttcaaaacatcatgttgtatgtgttaaatgtatttaatttttatagatcaattaaaaactattttttttaaaaagaatagactaaaggattataggatatatccaaaggaagtagaacaaatgaaatgcatgtaaaagcaggaataaatgaacaagaaaatcaaccatacagtaggtaaaaatcaacaaatagatttttttttttttttgagacggagtctcactctgtcgcccaggctggagcgcagtggtgagatcttggctcactgcaacctctgcctcccgggttcaagcgattctccttccgcggcctcccgagtagctgggattgcaggcgtgcaccatcatgcccggctaatttttgtatttttagtagagacggggtttcaccatattggacaggctggtcttgaactcctgacctcctgatttgcccgcctcagcctcccaaagtgctgggattacaggcatgagccaccacgcccagccaacaaattgattttttgaagagactaacaaaatcaataaacttctggctagactggtcagaaaatagcaggaaaatatattagtagaaatgaagaaaagggatataaacacaactatttcccaatatatttaaatatttaaatgcaaagagcaaattcatttaaaaaaaacaacatctacctggaatataacataaattagaatataaacttatagaaatggatataagaataatcttataatgaaagatactaaattatatgagcctcagatagtttaccaaataattccaacatagccccccctaccattctttgagtccagtattaacttgataccaaaaacataatgatagtacaacaaagggaagttataggccaaagtcattcatgaatacagtggcaaaaatcctaaacaaaatagcaaagcaaacccaaccatatgtatgaagaatgatttatcacaacaaagtcgatttttttaaaagtactattattagaaaaaatctctgaacgctaaaaggagaaaaaacttttatcattttaataagagcagacaaaggattgaataaaatttagtattgattcatgcaaaaaaaaatcctaacaaatgagaaatgacaaatagcttccttaaacataaagatgaactattcttaacaggtgatagcagcatctcaactcaatggttacacataaaagcgttttctttaaaatcaggaagcacgtaaagaccgtcatcacaacttagtttaacattgaactaaatggatcatatccactgcattaggacaggaaagaagacatatttttataatagatagaggttggaaaggaacaactgttgttaaaagaataagagaaacaaaaagaatcaaagaaacaaatagcatatgtttccattccatcactttggtattaatcacacttgtttctggagaccatggtgtaaaggaatgagccaggattactgaagggtcctgcagtgccagtgaccacaagacaagccagaaccaagttaacttagagtgaattggcctattctttaatactgctcagaattacaaactcccatataatctgtcacttaaattccattcaaattaataaaatctaattcatttgaataagacttaaagtgatttgattctactgcatcaaattctgctcagtggaatcagtccttgattgaaatctattaagttcaattcagtaaaataaatttaaatattatgcaatacaattaatttttaattaattaccatttcagttcaggtccattttgatctgaacttcaattctacatttctaaatttggtccctattcaaatcaataaaatgcagcaaaatccagtgtaattctaaaagatacaacctgaagctaatcaactgcatttatttctattcacccctaatcagatgagtttagtgacattcaatcacagaaagataaaatgctcacctttaactaccaaattgaatgtttacattagaacttcagaattaccaggttttcccaaactcacatcaccatctgcagtagggactccacaggattttatcttgactcattctttgtttggcttatatattaacatagaacaatgtagaattggatggttaggaaacaaaagagaatattgctatcctgtttaataagctgaaatcataggtaagttgagataatagacttttgcatctatgagaatgccaatacatgattttttattttatttttaaagttcttaatttaaatagtaaaagacaggaatttttgactccagaccatggttataaaactgagaaaaaaagtattaaaaggactgtattattcagaaaaaaataattgggaattaaattgagatgttactatagtaacaccattatcacctctttgtatcttaccaagcaaacaaggtcctggattggtatcccaatggcacccagtcatctgggcctctttgtttctttatagatgttcccaagtgtccagtgaactccacctaccactgtccttttcccaggtcagtatatggcagactggtctgatggtaaggatcacagggacactgagtctcaaactcttcctctgagattcttattctacaggacaggggatctatattgtttacaagatcttagtggaatcatagggaaattgaaaacccttccctatacttacctcccacccgtgggtgaaaaacaaaaaaatcagaagttattactccacggcttcacctcccccacttcatcctcctgtaaggatcctgagacttcagctaccatggcccagatcttggaagtgattctgtgcggattttccacatgtaaaagaagaggaagctgtctgtatttaagccagagaactttaggactagtagcctgtttccatttccagtccctgggggaggggttcccatcaggtttagctttaagcccctatattcctggaagcgtacacatccatactggggaaaacaagaaaattctggccggcttgatcttccaaattacagctatcagatgatttggaggactctatagaggctacagcacctccaaattccttctctgctccatcccatcctggagattattataaaagcttttacctttcttgttatctaggacatttgcactggaaggaaagtttctcacaggtgcaagaatgttttgaatggtctagaattgcaccaattaaggatgcctatacttagtaagtgtatcatcaccattcataacttaatatggattttgtaatcagatcagagtgctcagctgaaatttacttataaagtggagaaaaaagatttggtagtggtaagaaaggaagagagaaggaagtaggagatttttctgagcatgagtcgcttagaaaaaatcctgcactgcaagggccttcaaataaccaaatgttaccagagagcagagcctgggaaggactgccaatgagctgccggcaggggacactgggaacaatagtgaaaagcgtgtttgtgctgcaagggtacctgttctatttcctcagctgaagagcccccagggactctttaacagaatttgtagataaggttgtaattgtacatatgataaaactagttctcatcaagccaaaaagatgcttttacgttttcattttggagattatatacccttgtggtgttgtttttaatatcctatagaaacagtgggaatgaaagaaattaaatgtcccagagactgtgctgggtcttatctcagagggcgccaggatcatatttatttaagcagcctgttaagttactctgtgtagcccagaagttccgaagaacacattttgaaaatcacaggtatgcacctcattttcatcaagcagtccccaagcattcgcccttgtgcttctgaaacaacttcttgttattggtgaaaataaataacagaaatctattggtttctttttctttctttctttctttctttctttctttttttttttttttttttttttgagacagagtcttactctgtcgcccaggctggagtgcagtggcacaatctcagctcactgcaaactccacctcctgggttcaagtgattcccctgcctcatcagcctcctgagtagctgggattacaggtgcacaccaccacagctggctaatttttgtatttttagtagaaacggggtttcatcatgttggccaggctgattttgaacccctgacctcaggtgatcctcccacctcggcctcctaaagtgttgggactacaggcgtgagccaccgcgcccagcttattggtttttttaagtaagtcttggaaaactcctttcctttctagcctattttctttctccctttcccagtttaatcatccacaccataataaacccttcaccataataaaacttgatctgaagtgagtacaaacagtatagtgattatatttaattcatttcatatttggctgttttaatacaatatgccttactttgataatttagctctagttaacttagaatgccattcatcattacctaaccttgttgcagtgaccatagctacttaatatagttaaatacaatcttcatattctgaggttagagaagttcttgaactcttggaaatagataattcagttatttctttcctcaccactttttgcccttgtcttttaaaaaagctttccatttttattgcctttaactgctattccccaaagccaattaacaggtaaataatgatttgtaaagctaaaagtagcatttcattagcatagcactggaataagggaattctttgctcaaaataaattgaaccgttctcctcttgctgaatataaaatacacaacaaattaataatttattttagttacagtgatttaaccaaattagccaatgctaataacaaagtctacaatttcctttctctctggaatacgtttttcttattggcattcttttgcagtagatgtggaaagagctaagttaagcattttgtgctgtattttaacttattttcctaggaaaaagaacagaacaacatcaattttgcatcagcctcactgggggcattcgttatatgaagactaaagtattgtgacttgagaaagagtgagggatgggagaagaagctgggaaaccaggctgctcttgccaggtcactaacttgccacctccttgcacctgtactccttgcacatggaggaaatatttcagatcatccccttaggtcccatcctgttgtgtaataagagtccctctctactgtaagctgagggtctgccatatgagattagcacacagcctggatcccatgcacagctcagggcttctactggaacacccaccgtaaccgcccaaggagttcaccttgcccgctgcctagacagagtcgattcatcaagacaggggagttgcaatagagagagtaactcacgcagagccagctgtgcaggagaccagagttttattattactcaaatcagtctccccaagcatttggggatcagagtttttaaggacaacttggcgggtcggggggaagccagtgagccaggagtgctgattggtcaggaatgaaaccacagggagtcgaagctgtcttcttgcacagtcagttcctggatgggaggcaccagatcagatgagccagtttattgatctgggtggtgccagctgacccatcaagtgcagggtctgcagaatatctcaagcactgattttaggagaagtttagggagggtcagaatcttgtagcctccagctgcatgactcttaactataatttctaatcttgcggctaatgttagtcctacaaaggcaatctagtcaccaggcaagaaggaggtctgctgtgggaaagggctattatcatccttgttttaaactataaactgtaagtttctcccaaagttagttccgcctacacccaggaatgaataaggacagcaaggaggttagaagcaagatggagtcgattaagttagatctctttcactgtctcagtcataattttgcacaggcggcttcaccactgcccaaacaattcaacaatgaaacttcctttcctgggcttctgagcactctctgaaggtacagtgggaaccagctgtctctcttcttttcccctagagtatgttccttgtagtctcattctgaaggtaaagctgattgttatcttctccttttactgagaatgtcctaatttttacaaagaatactgggccacacacagctctctgattcatgcaaattattactgtctgcaatgaaaatgaaacacagtgttaggttgtttctactgatcactcaaaggaacaatcataaattgggcagagattctgagatatataatctttcattggttatttgaggtatgggcaggacaaaggagtcatctgctagacaaacctttaactccacttttacaggtgcccgatttgtttcttctcctccaccaagagtgttagtgtcctctagtttccaaaaacagtgatactaaccaaaaattcctttgagagaatttagcatgaggtcagctttttgaatgcaatgcaaaaaatgaatatgataatcagttttggtaatgtttctatattttcagggtcaggctgtggcctgcccagcctcaaaggcatttcatgaggtcaaaatggaaccatctacctttgtcctctctctataacatggccagagatggaatcagccaagacctagtgtagcttttgggccaaatgaccttaacatttctttcggtggttgagatgctgtggtttccataaatgggatatttcaacgcttatttttgaaactctagacttcataaggagaaaaatttattattggccatgggaagcatcagagaagctggatgctttaccacttaccctgatggaaaaagaaaggagaagcaaatgacttaaacatagaaagcaaacacagcccccgcatgctgggaccaggcacaggtggacagaagacacagcttcagggtggacctttatgtcagaaagcgggcatgtttctccctttggaacagggtactgagctctccctcttgactgtttaccagattaagtcaaatatactttctttaatgtgggtgccaaaaatggtcatgccaagggaaaataataacttccaaattaagtcaacacacagaaaaatcaagaaatttgtttggagggagagaatacctgaataactaactcattttcaaattcagagggcttgctcattcattacattcatcctggactccagtccctgttcattctcaactttaaatcacccacctgttaacaaaattattcttgaggaaaactactggaatatctgagaaagtaccacagtatttttttgcataattccaatatggtccctactttttgtattgtttgtttagatattgtgactgttcacatggtaactttatgattttcctcacctttatttctgagcactcatagagtcaagtgtacacttaacatcccaagagggtggatgagttattaccatggaattttaacccatatacccagatttttttttctttttttttgagacagagtctcactctatcaggttggagtgcaatggcgtaatcttggcccactgcaacctctgccaccgaggttctagtgattctcctgcctcagcctcccaagtagctgggattacaggcacctgccactgagcctggctaatttttgtagttttagtagagacggggtttcaccatcttggccaggctgatcttgaactcctgaccttgtgatctgcccacctcagcctcccaaagtgctgggattacaggtgtgagccaccacgtccagccccagagattttaattgactggctattttggcttactggctgacattacctctgttagattccactcattccccagcttctggcaaggaacctctgttctcttagcataatgttctcaaggttcatccatgttgtcacatattgcaaaatgtcttttttaggtctgaataatattccattgtatgtatacacaaatattatatgactctgcttatatgagatatctaaagtagtcaaatccagctgaatgtggtcactcaggcctttcatcccagcactttgagaggcagaagcaggtgaatcacttgagcccaaaagttggagaccagcctaggcaacatggcaaaaccctttctctgcaaaaaatacaaaaattagccaagtgtggtggcatgtgcctgtagttccagctactcaggaggctgaggtgggaggatggcttgagtccaggaggtcaaggctgcagtgagttatgattgctccactgcactccagcctgggtgacagagtgagaccctgtcttaaaaaaataaataaaatataaagtagtcaaatcatagaaacaaagaggtcaccaggggctgggaagacggggaagtaggcagttgctaatcagtgggcataaaagcttcagttaaacaataaaagtaagttctagaaatcagccatacaacaccatatcattaatgctacattggacactttaaaagttgtcaagagagtggatttaacattaagtgcattctcatatgctaaagtcatattaagaataagaaagagtcatccagtcagacgggttggctcccacctgtaatcttcgcactttgagaggccaaggcgggtggatcacctgaggtcaggagttcgagaccagcctggccaacatggtaaaaccctatctccactaaaaatacaaaaattagctgggtgtggtggtgcatgcctgtaatcccagctacttgggaggctgaagcaggagaatcctttgaacctgggaggcagcggttacagtgagccgagatcgtgccactgcactactgcactccagcctgcacgacagagccagactccatctcaaaaaaaaaaaaagaaagaaagaaagaaagagtcatccattgtcagggtcttcctgctctctgcttccattctttccactgcctaccacgtctaggcttttcttcccgccattcacctgaaactcctttcatcaaaatctctagtgaccttccagctgtcaaattaaaagaaaactcttagttccccatcttaatagacttcactatgaaatctgatggtgctggcccctctgctctctgggaaatcctcctgtgtttttctcccatcaccctggctgccttcgttcttgcactctgctatggtcatctccatctctggtacggtttggctgtgtccccacccaaatctcatattgaattgtaatctgaattgtaaccccatgtgtcaagggggggacttggtgggaggtgactggatcatgagggctattcccccatgctgttctcatgatagtgaggaagttctcacaagatctggttgtttgataattgcctggcacttcccccttcttgctttctctctctcctgcccccatgagaagacgtgccttgcttacccttcttcgtctgccatgattgtaagttttctgaggcctcctcagccacacaaaattgtgagtcagtcaaacctcttttctttataaatggttaaagacccagtcttggatcattctttatagtagtgtgaaatcattcttgggttttggtgggttttttgtttgttttgttttgttttgtttttgagacagagtctcgctctgtctcccaagctagggtacagtggtgcaatctctgctcactgcaacttgcacctcccacattcaagcaattctcctgcctcagcctcccaagtaactgggactagaggcgcctgccactgtggccagctatgaaatcattccgtttttgaaatgatgttgtaatctaaaagattccagcagcatttctcccacttccaatatgttctggtttgccctgatagttcctaaaacatattttcagctcagaaaatcctcctgagaaccagacttctacaatcaatttgtacattttgtgagcaaacccattatcttttcttcaacattccctagacttttgatgatgatcttccttccctgtgccctaccttcatggagcatagtaccatccccattcatacaaaccagaagcctggattaatccacagcactccctgcccatcttctcttctacctaaatcccaacagtcccagccagctataactcctgaaccttttttgtgtgtgttttctcttctcctccatttctactactattttattacttcttttctctattaacataagagcatcacatctagcctccctgaatccattttgcagaaatctatctttcatcttcctgttgatcttttgaaacacaaatttaatcatgctagttccctgcttaaaatcctttactagtttcccattattttcaggataaagttcaaacgtcttaaattgggggaagataaacattgaaaagaaaggataaaccaatgaaaaataacttcttacttggacaaaggtattttgcaatgtgaccttcatctgctgtccatctatctcttactatctactactgctcctctcagcacatctcttcagcccaattctactacatatgaatatagtcctatacatattttccaaatagaagtttacctttctgtctttttacattctgctccatttgcctaggaggtcttacctctcttatgtccttattgatctgtgtaatgcatacttgaccttcaagatgcagctcaactattttgcctcctctgggagaccttcctttatgacctcatttgcctcccccactctcctctgtgttcataatactgataaaactgttctccaatctgtatctttttcttccattctgttgagttgcttctaatgtttggcacattgtgggaacccagtggatgtttgatgattggatgaatgaatgaatgagtgactattaggccaaatgataaaggagagttgggggctaatctgctgtgtggttaaaagaactacttaactcttctagacctaaatttctttacccataaaattaggaggtcatactcaaaaacagtgaaagtttgtgcttagctccaatattctatgatctccatgacttagttcacaaaaaagcatgaccagtcacgagaattgtatggtgtagaatcagttcatggcccatacaccttcattgcggactgaccgcaacttggcttccagtttactaaatagactcctaaatcacagaagtttgaatgtaaaattgtcttccaaggagagaggtacatattcccatgagaaatcttaagcttaacactcccactgatattttttatcaaatatttctactattgacataaatttacctttatgcttatgtttatatttatatacatgtaaaattgtgatatatacttttgaaaactcgtctaagcttaaaagagccttttgaagtatagaattaaaagcttttttaaaaaaaacaaatttatttctgtaggtttttgggtaacaggtagtatttggttgcatgagtaagttctttagtggtgatttatgagattttggtgcacccatcacccaagaagtatacactgaatccaatttgtcatcttttatccctcacccccttcccaccctttcaccctgagtccccaaagtccttgtatcattcttctgcctttgcatcctcatagcttagctcccacttatgagtgagaatatacaatatttggttttccattcctgagttacttcacttagaataatagtcttcagtcccatccaggttgctgcaaatgccattaattcatttctttttatggctgagtagtattccatcatatatgtttgtgtgtgtgtgtgtgtgtgtgtgtgtgtgtgtgtatgtgtgtgtgtgtgtgtgtgtgtgtgtgtatgagaaacagtttatttatccattcattgactgatgggcatttaggttgcttccacatttttgcaatggtgaattgtgctgctataaacacatgtgtgcaagtatctttttcgtataatgacttcttttcctctgggtagatatccatttgtgggactgctggatcaagtggtagttctacttttagttctttaaggaatctccacgctgttttccatagtggttgtactagttcgcattcccaccagcagtgtagaagtgttcccctttcaccacattcacaccaacatatattattttttgattttttgattatgggcattcttgtgggaataaggtagtattgcattttggttttgatttgcatttccctgatcattagggatgctgagcattttttcatatgtttgttggccttttgtatatcttattttgaggattttctattcatagccttagcccactttttgatgggattgttttttcttgttaattcatttgagtttgttgtagattctggatattagtcctttgtcagatagatagactgtgaagattttctcccactctgtgggttgtctgtttgaaataaattgacttttaagagggttgagtgatgttcagactatcagagtattcctggggaagtgggtgtaagtgtggcagtctaatgactgaacccaggtctgtttctaaatatacctttgccttttcttgtagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggtgagtgcctgcgggcagcacagccaggctcaccctcccagtgtgcctttgtgtcaaactcatgtgatagaagaaagtttgaaaagtgctataataatacgataatagggtagaaaggtctggaactaacccaactgacaaatgtcaggaacatactgaaaaatataaaagcagaaagaggtcagtgcgacaagggtatgcatttagaaactgagacataattgatgtgttcatattttattcagagaggaaaataatgagccatgttgtagacagtgatttgcattataaaatgtgctgtgtaacaatagagggatggctgggggcgggaagccagtgtgcatgagtgcaggcagtcaacagcctcctgcggggagcacaaccacctcctgcaatgtttgcgttggggatctggattggaaaaataggagagagagagagagaagggaaaaaacaaagaaacagaaaaaatcattctttgctcttgtcttctgtaagtgcttgcctgtctacttttctttcatacctggaattgtttataactctgatacaaatcagttcaagaaagatctattttgggtttcttcgatccctttgctggcttttgttctgccccgcagtgaatagctgggtctgtgtcagtaacagataaagataagatcagctgccattctttgtgaaaaaggccccagaagtttaggtggaagactataaacctaagtgtgattctttgcagaagcacatatccagtgccggctttctacatttttagaagtgttgagaggctccatttctgcttctgggcagctgtgcacatagccagtcatggtcatgaatttccccatatgcccagccatggttttcttcagttcacctatgtagtatgctatttacagggacagtttacaagacaaattcattccaccagttaaccaaaaacaaattctgagaacgtaactttatatgaatttcaggtaggatgtctgcttactttctgaaagttatatttcttctagtaaatataacaaattacaaagcctatctatttcaatggcttagaatgtgtgtgtatatgtgtgtaaaatacttgtaaatagctatcattaatctttaattatggattattgtaaagaagagatcatgataatttttaattttatttctttgaaagatgtatctacacacacacacacacacacacacacacactgtatacaaagattggaagttgggaatggagttaaaagggcatggtctttgaaattaaccttttattcattcgttcaatcattcattcagtgaatcatccaatcagtcattcattcaacaaatattgatcaaatacttatgagtcagcaactcttctaggcactggggataaaataccaaatgcaaagaacaagaatccctgtcctgactcacattcttgttcttgatgccttttattactagttgtgtgttcttaagccaggcagaccttctcccatccatttgtctatccaacattaattccctacctcttcaggaagctgacattgggttcagcctccccaactaggagaagtgggaacagagccccagctggttcattgtccaggcagcccagagtgccctgccaccatcaccttgtcccaccacagaggagagaagagggattcagaaagagtaagatctagtacctgcacctaagtgaacttcatttttatcagacatcatgctaagttctagggatacagtgatgaatggaacatggtatttgtcctcaggagctccaaaactagttgaaggaaacacacatgtgcacacacaaatagataacataatacagtcagtgttgtgaggaaggtgtgtgcaagatacaacaaaaactaatgaaagtggcggggcgtagtggctcacgcctataatcccagcactttgggaggccgaggccagcagatcacctgaggtcaggagttcgagaccagcctgcccaacaaggcaaaaccccgtctctactaaacatagaaaaaattagccgggcatggtggtgggtgcctgtaattgcagatactcgggaggctgaggcaggagaatcgcttgaacccaggaggcggagcttgcagtgagccaagatcccagatcgtgccactgcactccagcctgggtaacaagagtgaaactccatctcaaaaaacaaacaaacaaacaaacaaaaaaaaactgatggaagaaattttcaatctaactggaggagtgaaggaaggaatccataacgtcttggaggaagaggcataaacttgaaagacaaggaaaagcaagggccctgggacactcgcccttgcatggtggtcttggagaagaagcatgacggagctgggccaggctggggaactgtctgtgcagttgacagttttgaaaacattaaggccctagcatgacatctgtgtctaaaccctgagggctaccattagtagaattacaggttgaaaacatagattttttttttgagatggggtctcactctgtcacccaggatggagtacagtggcaaaacctcggcccactgaaacctctgcctccccggttcaagcaattctcctgcctctgctggcacctgccaccatgcccagctaatttttgtatttttagtacagacggggtttcaccatgttgaccagactggtcttgaactcctgacctcaagtgatccaccctcagcctcccacagtgctaggattacaaccatgagccaccatgcctggccaagatagatctttattttttttattttttatttttttttttgagacaaggtcttgctctgttgcctgggctggagtgcagtggcgcaatctcagtgattctcctgcttcagcctcccaagtagctgggactacaggtgcccaccaccatgcccagctaatttttgtatttttagtagagttgtgatttcaccatgttggccaggctggtcttgaactcctgacatcaagtgatctacctgcctcggcctcccaaagtgctgggattataggcgtgagccacggcgcccagtcacaagattgatttttaaagatatatattagcctctgaagccatttcaaagaacatgtctgaattcagatcacagattagaagacattccattccacccttattcccagacctcctcctctggcaagcttcaattgagttctaacatttcacagttactcagggacttggtcactgctggtgtcttgttctcttctggcttagcagcagctaagacatcccactcctttgcttccgtaaagtttgtctaatatttcataataaaggcactatagcttgagcaaactgaaaagtataatgaatatttttttttttaagagacggagtcttgctctgtcacccaggctggagtgcagtggcatgatctcagctcactgcaagctctgcctcccgggttcacaccattttcctgcctcagcctcccgagtagctgggactacaggcgcccaccaccacgcctggcttattttttgtatttttagtagagacggggtttcaccatgttagccaggatagtctcgatctcctgacctcgtgatctgcccacctcggcctcccaaagtgctgggattacaggcttgagccatcgcgcccagccatgaatgttttttataataaatagctcttaaaatggtcttccctttttagcacaagaaagaatgctcttggagaaatcttcttggtctttgaattcaccagcacctagcaaaggccctccttcctatgtggatgctttagatatttgggagtggatggggttgcttctagagacactttctaaagctctcaggggcagtgaagagaaagttgagcttgatgcgggtagaccttacatccaggcccagatttgccacttttgggggaggcttttaacctctctgaaatttaatttattatctgtataataaaaataaatcttggcaaatttttgtgatcattaagaatatagaatataaaagccttctataaattatactatatgggatagttatttgcaattctattgcattattttaaaatttattttctttatttatttattttgacacagagtcactctgtcaaccaggctgaggtacagtagtgtgatctaggctcaccgcaacctctgcccccagtctcatggctcagcctcccaagtagctgggattacaggcacgcatcaccatgcctagctaatttttttttttttgtatttttagtagagatggggtttcaccaggctggccttgaactcctgacctcaagtgatccatccacctcagcctcccaaagtgttaggattacaggcatgagccaccacaactggcccttatcacaattcttaatgattccaattgactcttaaatgaaaataaatgaaaacagagcgtggcaagtaggccccttcatgctcttgacctgctgtgtcgtaggcctcaagtctaattccacaacgccacatgcagatgttatgaaacaggctttactagagaaagttataaatcagggatcatcatcagaagagcaagtacaggtctccaatcccatcatccctcagggagacgtgcgaaagccaggctattccgctgaatgcaccaagggcattcgttaccaggaagcccctgcttctctcacttctcacaaagcaaaaatgacagcaactttgtcagtaggggaaaatcagatgcatggggcaccaggcagtctgggcataggtgcctgctgtttacaagtgttgtctgggagtcagagcccctccaggaacagggaggaagccagagccccttcttgaagctgactttgggtgtagtctctctaactaggagaagtgaggaacactgtccaggcaacctggagtgcactgtcacgatcattgctgttcagtttttttgtttctccaaacacagagaagggctgggagattatgggaaataaaaatgtagcacatacatccaaatgaaactcacatatgttaaaccacgtttgttgtaatgtcagggtaaaaataaaggttctattaaatctcatgcttttagatgctttgtccagttaagaaagctattttcaataatctgaatcacaaagcatcattggattaagatgaactaagaccaaaatgaggacaaagtacccgtgccacttcctttctgtgtgatctaagtcaggatatttcacatctttgttttcttatcagcaaaatagaaatagatagtatagtacttcccaagtcatgtaaggatcttggtaaattgctgtcataaatgaaagtttaaaattacagtgtgatatattatttttattattatttgaatgttgaatggaaccttagctaaaaattattttaaaatgtcttaaattacagatgcataaattggggccctgaaaaatgtaaattactttcaaaaaattacagtagaaatgaggagtagaaagaagaccaaagacacacatctccaaacacccaggccagtgttcttccacaatatcaggatcaaggaagtttttttaatattgtttttatctatctttttaatgatttcagaatgtaatttttaactagcttatatgtaagctttaaatttaaagcttaaaccacagaccacattatatgttctttttctaagaactctaaaacttagattgaatacttattcttatttactggtgtaaaatgcataaaaatggagccaggataaatgagattgcagctcagagcatgattgggtctcacaacgaagctgcaatggcctgtgagtacgatcaccatttcaataattgcctgattatctatgctgggagaagttttgcgcagttatttctgagattgaatgtaatttaacatttatgatttactattcacagcaatagtaaatattcccacctacagtgccagaattctaattacacgagtcttggtctcagctaagtggccactgctgggtaattcctggtctcttgcagcctgactcaatgagctaaatcaccatatctgaaattagcaattcgaaaatgaaattatcagggaaagaattgccattcattgcgtgagtacccttctcttattgtagaatttctggatagttatgtcctggccaagatgggcacatacatggtggaaaataagtgaagtgaaaagccgttagcacagtctttgtgttacaattagtcagcagttcccacctcaacattagaaaggccaaatactagccgttgtgctctctttcgctgaccctaaatggaattggcttgtctaacagcctttttcttcctgggccaaaaataatccatgaccaacttttatagcagctgaggggagttaactaaaaaatatcttcgatatttcaaagccagaaacatatttatttggttgggtcagcttactatccaacacctaattctgaatatttttaaaaataatcgttataattttttgtccttgtttataagaaatttgattgaatcttagtgacttttttcatgaagttttagactgcctcttactcaaagtgaaatatttatatatgcattctcattcgtcatgttgtttaaataatagtagttacatgtcagccactgttcatgtatgtttcatatactgtgtcatttaaacatctcattgactctatgccaaaggtactacatattttgtctttattttagaaatgctccagagagattaatttctcccacaaggtcatatagttaaaaagcagtagagcagagattcaaactcggggcaagcaactttagactcatccttaggaattacacaccaagactgtattagcctgttctcatgctgctagtgaagagacacccgagactgggtaatttataaaggaaagaagcttattggactcacagttccacatggatggggaggcctcacaatcatggcagaaggcagagggaaaagtaaagccacgtcttacatggctgcaggcaagagaacttgtgcaggagaactcccatttataaaaccatcagatctcatgagacttagtccctaccaggagaacagtatgggggataccacccccatgattcaattatctccacctggtcccgcccttaacatgtggggattattacacctctgggtgagatttgggtgggaacacagccaaaccatatcaaagatgtaagttctgtataaatttttcacctgtgtactatatacagcacaatttcattttttttccaatttttattatggtaaatacacataaaatgaactatcttaaccatttttacttttacaattcaatggtattaaatgcattcattttgttgtgcaatcatcaccatcatccatctccagagccgtttttatctagcaaaactgaaacgctatacccattgaacagtaattccccatttccctctcctcctagcccctggccagttaaccttaaataatgagttcagaaaatgtgattaaatatagagtttattccagctcaaagcctgaggatagccaccagggaaacaccaactccaagtgaatggggtcagctttccaaagtgggaaagttaaggtttcacttacataggcagaaatagagaaggttaacagggttgcaacatttgccatataaggccagcacagatgttacggtcatttgattggttacagtttgctatgttccaaggaagattgctttaacattccataaggaggggtaatggtctcgaggggtcttatttctggaaccatttggtcttttctaatcatttacaggacagaaatgaggaagagatttaatctataatcagagaagcagaagttgcagctgcacgtggcataactcaggccacataaccacatttctctcaaggctcaaaataatgtaaagttccaaccattttaagtttgaattatttgatttcacaccaccatcgttctattttctgtctctgtgattttgactgctctaagaacctcatgtgagtgaatcatatagtatttgtctttttgcagttggcatatttcacttagtataatgtccttaagttttgcctattttgtagcatgtatcaggattttccccctttttaagatggaataatattccattgtgtgggtagaatacattttgcttcttcattcatttgccaagggacacttttatttccacattttagtgactgtgaataacgctgctacgagcacggtggtacaatttctttttaacgtctacttttactcacctctgtagtgctcctgatttggtttctaaaaatctcttattttaattttatattaaaagtattcattatgacaaatacattcaaattattttctgaatgtgacctgatttcaaatcctagtcctattgcttgctagttcagtgaccttcagcaagttataaaagctgtcaatgactgtttccttaaccacagcatttaaatggcactcacagctacctcacatggtagaaagggagtttaaatgagaggatactcataagggagaaggcacatccatatttcactagtaaatgctcaagaaatattgattccaattacacccaagcacacacagataagggttagctcatgggttccccaggagcagcctcttcagtattcaaaaacaactcattgggcccctctgttctgacctccttgcctgcatgccttgctgccaccctgctgctgacactgccctcctgagatccttactctgccagctgcagctgtctcagcctgtgacagtcactgatgcccttatggagagatggagagggccccctactcaacctcagtgcagtggaaacgaagctatggctttcagcaagacttgacaaggattggagctaacagaaattttacactgagagaaacttgcaactgcttcctgaaatagccactcttcaaatccaggcaggagcccagcccctgagaccctgccaagctcccagcgaagcctcctatgggtctcaaccctgctttcattaatgaggctcctcaggcatttggatccaagccaaacctcctccaagccccagaggaagaagaagttcttcttcatcccaagccctacctcagttcctacaggaggaacatttgcttctcaggctgattgatagtgcaataattaaatcccttaaggaggaaattcccagcttaagccacaaaggtgtgcgtcaatcacctggcctgaacgggagcatcgctgtggtctgttctgggacctgggtttgttgagtgcatttctccaagctaagattccagtcttcagggacgcctcctgtaggacaacagtctaatgcaatgtgtgcagtgacaatatcagtcaagttttatttcatgatgtctcctcataaagagaagagaaggtaaagtcagcaagctcctccttctatgatttcatgggagaaaaagccaagacaaaaatgtaacacatgtccaaaggataaaaaggagcttccagggataagccagtttaaatccagatttattgggggaggaaggagcatctctcatactgctggcacaaggtcctgctaaatttacagtattcaacagaaaaatcacttcgcaaggaatattccattttaattcctgcccccaaattcaggagcaatatggaagtacttgccaggcatgtccacagatgaaaagccacaaaagtgatctctcaggaaatagagattttaccctcagtgacaacactggaaatcactttataaccactgcttccattccacctgctcccaccttagacaaacaaacacaaatggtttttacagcttcagatttttagggcccaacaacaggcagttcaatgaaggaaagataaagaaacatggacaatggatatttaaaaagaatttctgtttcataggttttaaaaaaggtttctaacatcagtctggaaaacagaaaccttaatacgagacagaaggtactgcacgatggcagctaggagcctggctatagagtcagaccatctacgtttatgttcctcctccaacactcagccagttagtaagacctgcctgtgcctcagttttctcttatctacagtggagatgaaaagagcgtgtctccagagatgatgtgagaatcaggggacccaagcaagctgagcatcattctttgtcctgtcagtggcaatgggactggaaacataacctttagtacaactgggtaggaatgtatgactgaggttacttttttgagggctatttgggaattgccatcaaaacttgaacactacattctttgactgaatccttcaccatatggcatgtaccatcttaaaaaaaatatatgttctaaggtggcatataccattttttgtagcagtcaaaaaaaaaaaataacctgtagacagcagaaatgtccatgaatagagtttcagaaaatgatgttataaggctggccaaggaatgaagtagatacataaacacttgcacagaaagatggccaagatgaaagtgaaaaaagcaagttgacaaatagcaggtataatacgagtctggtgtttcttttttaaaaaaaaaattatttaggctggtcgtggtggctcacgcctgtgatcccagcattttgggaggccaaggtgggcagatcacctgaggtcaggggtttgagactagcctggccaacatggtgaaaccctatgtctactaaaaatacaaaattagtcaggcatagtggcacatacctgtaatcccagccactcgggaggctgagacaggagaatcacttgaacccaggaggcagaggttgcagtgagccaagatcgcatcactgcattccagcttgggtgacaagagcgaaactccatctaaccaaaaaaaaaaaaaaagaaagaaaaaaaattatttttgagaagggtctcactgtgttgccccagctgaaatacagtgacatgatcttggctcactgcaacctcgacctccccaggctcaggtgatcctcccacttcagctgggactataggcacaaaccaccacatctagctaattttttgtattttttgtagagatgggggtcttgccattttgcccaggctggtctcgaattcctgggctcaagcaatctgcctgccttggcctcccaaaatactgggattacagttgtgagccactgtgcccagcctggcatttctctaatgtgtataatccataacctttatacatgcatacataatttctagaaaatctacaaaagaaacaattacaacgcaatagattaaggatgtaggactttatggaggacctggcttgtcccattgtacatcttataagctctttgaattttttgccatgaacacatttaacctgatcaatttaagtatttaaaaatagtttagaaattaaaataaaaaataagaatcctagccagcatcccagtacataataaaacaatactaaattcttattttaagaaaaatcagatcaaagactaattttcacatcatcaacaacaaaaccaaacaaagcatcttactggctctcctggccccaatattggaaggaatttctcagcaagctggaggattcctccgctcagcgggcgccgtgaaactgagaatattcataccattagccctgtaaccacatgcaaaacaaaatagttttttcattgatctgagttctgtggaactcatgtttgtgctcttaaatcttttggaatccttctggggaacaatcacttgacatcccaatactcagtggtcttattcgtgcatattataggaatatgatattatgaggagtactggtatcagttatgacaccagttgctaaactgaccagaaagattgttgatattcaaataaatgtgtgtgcatgtgcttgtctgtgtgtgtgtgtataaaataaaatgttaaaatggacagctatcaatatattttctttctagatacataaacggagatgccctcctgatctcatgaaggccattttcattaagttaagctttgttcattttcattcagttaagctttgtttaaaaaaaaaaaaaaaagatattgctttaccagtgatctgggtggcgggcgggggtgaagaagaagaaaaaaaaggaaactcttaattttagtcctatttagccccaaagcatgtgtttcagtattagagcatggccagagcagttttcaaaagggttacaccatcccgtgtacgttactccttatactgactccactgtggtttacttggcagatttgagctatgctgaagttgcctcttaacaggagattcctagagcgtctaacagctcaactcttttaggagcttaactactttttaatatgtgggtcagggttaagagcctcaggcaagggcttctgccctctttcgttaggaatttaccttggggatgaactaaaaaacttcaggaggctcatccaggcaggttccagatagctcaaattgcaaagctacctggaaagccactgtgtttctgcagccctgtgagtgaaacacctgttattggcaatggggaaggggaaatgtcctgtctctcccagttccccaaagaagcataaaaatgatgtattatatactgtctcagggacattttggtgccaacccacttggcacagcatagaatcctcctgtcacctcatggattgtatcatgacagaagggtaattgggcaccggagaagatgtcagcagagtgtcaatacggtttggccactgcccccaaataatattgatgacagcaaagagagcgattaatcaggtgtgatcctgtcaaatgttcagagtgtgctgtgggtactagaaatagatatagcctaccaacaaaatgttaaatggacttaaacaaaatagattatttagtcattttgagaaaagcagaactaagattcaaaagagctttttttctgaaaaaaaaaaaaaaaaatacagtgtatttcccattagtatttctctccacttgcttgaaaaagagggagagctgttatgttttctgaaaaaaaaaaaaatgcattctgcccaaaaaatcaatcatggaaaaaaaaagatcaaattaaaagagatgtcatgggatctaaagaaaagtgcagacgcagcaattgtaaaacacgttataattgtggacctatctgtttatttattctgtgtcccactgaaagttcaccctcacaccctccctaccaggccagccatctcctcccattaccccctcttgatattaatgatgctcgctcacttgtagtttcccacgtgtaaaaccccattgccttatgtattatcagttgttcaccattttccatacatggattctgtctcccctgggcctttcacagacacctgaccatctgtgaccatggcctttctcctagttctaaatctaagcaatggtattgcaacaatcttccaaaataacttccagccttaaaactctcttatcctacaactctgtctataactgtggccatcactggcttcacattagaatcacctggaaaacttaaactattacttatcattaggccctgcctcagactaattaaatcaaagtctctggagattatttttggccatctttgattttgcaatttcctgaggtttctaatgtgtagccaaggttaaaaaccattgatatagggctaggttaagctgcatataacagaaaaataactaaacaagagtgcttaaacaagatgaaagttagttcccatgcatgtaaaggaagtccaggctccttccagctctctgttctggtgttattcagatttgacatcctcctcaggatccaacatggcttctagagctccagccattatgcttccattccaggcagaaggtagaaaagagaggaaagagagcatgccttttccttccaagaatgactttacataccacttccatttacgtatcattggctggaactttagttaaccacgactagcagcaaagatggctgggttctgtagcctttaactgggcatgaatatgccttcctaaaaatgagcattctgttaccaaggaagaagaggaaaatgagcattaaggggcaactaagagcctctgtcggaagtgttaattcttcaaaggggccctgctagtctcctgttcacacctacagtaggtccctgtgatctccagaataaagtccagactcctgcagttctggagtccctcctcaccttgcattctctgctttacctcactcacactggggccattgtaaggatatttgtattttctcatcgctggtcctttacctacacctaaaataactcttcacatatctgcgttttcaacatcatctacttctgcagaaccagcgccagtgctgcttcccaaggaaacctccctgcctttgcccacacccctcatgtctagcaaaagtccatgcataaaaggcctgcttcctgagggtctcaaagcaaattacacttattttaaagttattttctctcttatctgcaattagatgcctgggtatctgagttctctctcaaattacaagcttcaggaggtcaagcaccatacctcatgtgtattataagtcattcatgcctgtcacttagcagctagtcaacatctatttgcaatgtaagccaaatgtgtagcactttagagaatccggttttttgtatgtatttataaactttctttttgcattgagtcataaacccacatagacatacactcatctctgctttaggctttgtagatggttttagttcacatagcaaaaattggaaagttactttatattcaatagtgaggtaaatcatccaagtcagtttttaaaaagataatgggtgtgtactaatatgtatgtccatactcacatagacactgacacgtgtatacaagtatattacatgcacatcctacattactaaatgtgatgtataatgactttattaatttttttggaagcatgctagttgtcttaggctaatttaatgcccggtattaaggtgaaatcaattactaccttttttcatcaggactagaggaggaaaaaaacaaacagaaaaactacccttatgcaggaggaataattctaaagacagaaatacaggatgtttggaaatgaccatctgtgacgatatttacctgcttgtccctgtcagccctgggaatggtgtgtctttaccttaggttactatattaggcagaataatggcccccaagatgttcacattctaattcccagaacctgtgaaggtcctacttcatgtggcagaagggactttgcagatgtagttcaaggtacagactttgagatggagagattatcctggactatcagtgggtgcccagtcaaagcacatgacttcttaaaagtgagaaaagaccctttcctggctgtgatcagaaagaaatgtgatgacagtagtaggctcagagagatgctatattgctggctttgaaggtggaggaagaaatccatgaactaagacataaaggcatcctatagaggctgaaagagacaaggaaattgactctcacagaggctccagaaaggaacacagccctgacacaccttgatcttaatacagccagacccatggtctgaattctaatctacagaaccataagataatatgtttgtcaggttttgtttttgttttgagacaggtctcactgtgtcacccaagctagagtgcagtggcgcgatcacaactcactgcagcctcaacctccctgggctcagatgatcctcccacgtcagcctcctgagttgccaggactatacgcatgtgccaccatgtctggctactttttctttctttttttttttttttttgagacagagtcttgctctgtctcccaggctggagtgcagtggcgcaatctctgctcactgcaagctccgtcccctgggttcatgccattctcttgcctcagcctcccaagtagctgggactacaggcagccgccaccacgcctggctaattttttgtatttttagtagagatggggtttcacagtgttcactaggatggtctcgatctcctgaactcgtgatccgcccgcctcggcctcccaaagtgctgggattacaggcgtgagccaccacgcccagcctacattttctattttttgtgtttttctccgcgttgctcaggccagtctggaactcctgggctcaagtgattcacccaccttagcctcctaaagtgctgggattataggcatgagccaccgtgcccggccacatttctgttgttttaagctacttcattggtgttaatttgctaggcagcaataaaaaattaagtttccttcctacggtggtgatgtcatcaaaaagaccccgtaaagctttattttttcctctcacattggtatagagtgaaagttcactggtaaaatagctttgcagaaaccttaaaaagtatgccttggccgggcgcggtggctcatgcctgtaatcccagcactttgggaggccgaggcgggcagatcaccaggtcaggggttagagaccagcctgaacaacatggtaaaacccgtctctactaaaaatacaaaaattagctgggcgtggtggcacatgcctgtaatcccagccactcaggagactgaggcaggagaatcacttgaacctgggaagtggaggttgcagtgagccgagatggcaccactgtactccaacctgggtgacagagggagactccgtctcaaaaaaaaaaaaaaaaaaaaagcatgtctctgaaagtgattttgtggctaacaccctgtttccctgcctgtccatcacttgctgatgctgagagcttccagcctacgaagaggatgtgcagggccttcgttcactgataaccagctctaccagtgaaggactggttgtctgtgcctacctgtgatcaggtctccttcaagtagatgattatatagcagttggcaggaattttttaaaactcagaaacattcatttatacatccaatcattcagctcatgtctgagtccctgctatatatcaggcacagtcagactatctggcagtccttggaaacacagggtgggtgggtagttttaagtcatatgcctcctgctgaaagacagatttaagaatgtgtcttcacaatccctacaccactgcaatttcacgtatgtgcttctgctcctgtcttttttttttttttttttttttgagatggagtctcactctgtcacctaggctggagtgcggtggcgtgatctcagctcactgcaagctctgcctcccgggttcaagcaattctcctgcctcagcctcccaagtagctgggactacaggcacccgccaccacgcccagctaattttttgtatttttagtagagatggggtttcaccatgttagccaggatggtctccatctcctgaccttgtgatctgcccacctcggcctcccaaagtgctgagattacaggtgtgagccaccacgccctgcctccttttttttttttgtttaacaggcagagaaatgattagataatgaagacgttatttattttttattttcataataatgaattaaagaggatcttatggacattctgagctttcccattgtaacagcctcatttatggcagacgccatttgcctgctgtccacaccgtacttaatttggcctcaatctgtatctttggtgtattaatctcctcatgatccagataacctcttctccattaacaatggggttttatagctaggacagtgcctggaaagttataagcattattattttctattattattatttaggagatgttttgggcagcttactacattgcacagaagctatctcatttcctagggactttgatgcaatagtcaattgtaaaatagacttttccaaagtcattcatttcatccattcctttaaacacctaatttttgagttcctgttatgcacaaggtagtctgctaagactaatgacaatgataggtgaatgccacccctgctattatcatctttagggctttgagaagttacttgacttttctcacttcagtttcttcatctttaaaatgagaatagtaatattactgaccttgtgaagatccccatgtttatgcaatatgggtattgttttatcaggcctttgtatttcagaagtttataagcctcatgaacaggagcaggggaccaactagacaaggaaagaggcagatctattcaacaaacatgtgttgagtacttactatgcacaaaggcaggatatcaatatggggggtaggaattcaatggtgagtaacgctgagacatgtggtgggattttagagcacacattttgcaaatcaaagagaacttgtgaatccctgtaacagccctagtgaaaattgttaagaatgattctggcaagtcccatattagccatatacaaattatccccattatagacttcccatagtgtatatctctagtataaaaagcattacaataatcacatttaatccttgttacattttaaatacgcatgtcgatgcaaattacaaatatcgaaaggaaaatgaagacagaaggaaaataaatcaagaaattcatttagagaaagaaaaatcacaatataaaacagccaatctttcttgttaagagcagccctcacatttctaaatgtatgaattggttttgtgttgactgtgccccaaccctgcttatagtatgtcaatattgggagaaatccatcactgacactaacatggcagccctctgaggagtcaagccaggggcatctagaggggcaatgcccaggcttcactccccctccttttgaaaggctcaggttgccttatagtcttccataaaaatactgagggcttttccaggactgctcactgtgtgataggaacttacatctatagggcatgtggtaacatgcaactgaaagcttagatttttttctagtgatgggtcacattctacactaggtccatcttgccattggtgccctgaagtgctttgtctaggccaactgatgcagtccacagagtctaaagaccactcaaactactcataacgtttcttgtggctgcccatccattccagttctaggagtagtttagaccatgttcatctctattaattatctcaagtctttatgcagaaacagcaacaaaaataggctatagaggtatgagaagtggttttgaattgttagtaaagagaggatgcaaaaatcagtttgtttgttgtcatttatttcaagctcaatattagatgccaatgttagggactatcaacatacaaagaacattttttaaaaacactcttaatgacaccttagtcaagtgtccaggttataggagtttccagcaagcatcagctagaccacacctgaagaattataaatagtactaaaaaaccaaaacatggaaaatgaggtcaggaatttgataagtgtccaatataatgataatgagcaaaaaggaaggaaggaagggaggggagggaaggggaggggagatgagaccactgtccatgcaataatccctttcccagtgttaacagttgaattgtgtccccacaaaagatatattgtgaacgtgacatgtttttgacatagagtctttacagatgtactcaggttaagatgaagtcattattaggtgggccctaattcattattactgttatcctcatgagaagaggaaagacacagggacagacacacatggagaggagaatgccatgtgaagacccagactcaaggagaacaccacgttgggagggaggcagagatttaagtgatgtgtctaccttccaaagcatgcccagggttgcctgcaacaccagaagctaagagaaaggcctggagcagattttcccctaggcccttctctccgtttaaatttatttttaaaaattttttagaggtggcatctcggtctgtcacccaggctgaaatgcagtggtataatcacagctcactgcagcctcaattgccagggctccagcaatcttcttgcctcagcctccgaagtagctaggattataggcatgcaccaccatgcccagctaattaaaaaaaaaaaaaaaatttctagagattttcctttgtaggaattttctgtgttgcccaggctggtctcaaagtcctaggctcaagtgattcttctaccttggtctcccaaaatactgggattacaggtatgagccaccatgcgtagcctcctagagccttcagaaaaaaacgtagtctgcaaacaccttgatttcagacttctagcctccagaactgtgagaaaataaatctctgttgttggaagccacccagtttgtggcattttgtcatggcagtcataggaaatttaatgcattcagcaatgctgccagagatggccattcccctctgccagcacattcctaatgtggtgccagtctcctaagccagtctgatgatgttggacagctccaggcatttgctgagggcttcccaaatgctgggcaccactctaagcacttttttcttttcttttcttttctttttttttttttgagacagagtttcactcttgttgcccaggctggagtgcaatggcacgatcgcagctcacccaacctctgcctcctgggctcaagtgattctcttccctcagcctcccgagtagctgggattacaggcatgtaccacaatgcccggctaatttttgtatttttagtagagacagggtttctccatgttggtcaggctggtctcgaactcctgacctcaggtgattcgcctgccttggcttcccaaaatgctgggattgcaggtgtcagccaccatgcaagcccacactaagcactttatctgcatttccttatgtaatcttcacaaaaacctataaaataggtacaattacttttccaactctgtaaataaagaaaccgaggcttagagaggataattaacctgcacaagaccacaccattcataaggagtgaacgggaggcaatctgatgctgcagccatgatactccacctcctgtagagaaaaggggaatgagtgtgatggttaagagaactgaaagtaagccgggaagatggaacagagaaggaggcatggagaaaggtgaaagatgtaagcccagtcttagactgtccttgtgcagagtatgagagccaagctgtacatagagtagacagagggagagtcatccacacctctcaagtcagaaagaaagagaatgtggcaaggtgtggtggcgcacacctgtaatcccagcactttgggaggcctaggcgggcggatcatgaggtcaggagatcaagaccatcctggctaacacgatgaaatcccgtctctacaaaaaatacaaaaaaatttagccaggcttagaggcacgagcctgtagtcccagctactcaggaggctgaggcaggagaattgtttgaatctgggaggcagaggttgcagtgagccaagatcatgccacggcactgcagcctgggcgacagagcgagactccatcagaaagagagaaagagagaagagagagagagagagagagaaggaaggaaggaaggaaggaaggaaggaaggaaggaaggaaggaaggaaggaaagaaggagcagttttaggttcacagcaaagtaccccctaccccctacacatataatgcagacaaacacacacaagcgcgcgcgcacacacacacacacacacacacacacacacacacacacagctttcccccatgatcattcaacacagggtagtatatttgttatactcatgaacctacattgacacattatcatccaaagtccatcatttacattgggtttacacttgctgttgtacattctgtggattttttattttttaattttttttttgagacggagtctcgctctgtcgcccaggttgaagtgcagtggcgtgatcttggctcactgcaagctctgcctcccaggttcatgccattctcttgcctcagcctcccgagtagctgggactacaggcgcccgccactcggctaattttttgtatttttagtagagttggggtttcaccatgttagccaggatagtctcgatctcctgacctcgtgatccacccgcctcggcctcccaaagtgctgggattacaggcgtgagccaccacgcccggccattctgtggattttaacaaatgtataatgaaatgcagctatcattagagcatcacacaaaatagtttcactgctgaaaactattctctgtattccctccattcaatcctcccctcccctcaactcctggcaacaactgatcttcttactgttttcatagttttactttgtccagaatgtcctatagttgaaatcataaaggatatagccctttcaggttgagctaattttattttagtgataaaaaatgttaaatagtatgtagaagaatttagggatgctgacactgtgaaaacaaatatatttaattacgctctacttggagtttgtttaaatcagatgtaaatgatatttgagctgattataccttcttcaaatggagtcttatttgaaagtctagtatgaagagatattaaaatggagcatgtctgggcaaagggaaaaagagattaggagttccaacaactccacacctctccccacgcctcatcctccatgatggaccttggagacttacatgaagcctccagtgcttcatgaaacacagcattaaaaccagatttcagagattaggactttaaaaatttagtgaatttataatagaagtatgatgaaaatgtccttttcttccataataaaatgggaaggtacattctataaaactgtcaaagtttacctgatgtttgatttatgcttttaataccttcacatacactttcttgagtttgttcaatactaatagtcaaaattcaaagaaaattaaagtcaacatctttttacttgttgaacacattaagtcactgtgatctacatgtaattccatcctctccaaattaaaattaaaattaaagttggattgactggtatacagattacagttcatgaagtctcgttatataacctttgaaccaaagtttatcttataaacacgtaagataaatgtcaaacgggaaagtaaaaaagattttataaaggaaaatagaagaactgaaggcacaggataaatctacatgaaaaaaacaaagagcgtttttaaacacttcttcatgtgaattcaggtgataatacaatggagttattttactcttaagacagattgacatatttaaacatagttctgatgatgtggagatgtctacagaatatatttcctctctaatttaaattatttataattgcatagttagttacaaagaataaaatcaaattaattactaataaatgccagagaaacatgtttaaattgacattcacttccaaagtcagctcctgcataatcaccacaaatttttaatatttgctacaatatgacaataaaacaattgcgtatattacagagtagaagaaactccttcaaagataaatatgcatttattctatttagttgtagaatgataaagataatttttttagaatggtctaaggataactttttcaagaaaaaagatgaaaaatgttctgttcccccaaactatcataagcctgccagccacacctctgccttatcatattcaacctgagtagatgacagtcgccacttatgccatattgagaaaaactctgatggtctgattagattcattgaaatactttcagtattagtagctaaatagggttctttttaaagtttaatttaacctaagagttgtaaaaatgaaataaatattattttaaatattgtagaataagtcaaacacttttagtttcaaatggattgtcaagataactgatgtactccgtaaatatatacatctactatgtgttcacaaaaatttttttaaaaagaattggtaggcataggctagtaaattgaccaatatcttcatttgcttaaaataaatttctaaaaccaagttgttccttgagacatatgcaatatcttcagaatttcatgccataagattaactatacttgatcaataaactttgaaattttaaaataaatacagaaaagttctttctcaattcagaaataactactgatattccctgggtgacttttttctcagacaagttagaaaaccaccaatttgactagattgggaaattccttaaaaggaaattagtgcaatggccgagaccttgactctgggatctcctaagttagagtcccaggactacctaccgattatcaattaaatatgcagtcttggtgatatggtttggctgtgtccccactcaaatctcatcttgaattgtagcttccataattcccacatgtggtgggagggacctggtgggagatcattgaattatggggcagtttttcccatactgtcctcatggcagtgaataagtttcacaagatctgatggttttataagtggtttccccttttgcttggctctcattctatcttgcctgccaccatgtaagatgtgcctttcaccttccaccgtgattgtgaggcctccctagccatgtgaaactgtgaacccattaaacctctttttctttataaattacccagtctcgggtaattagcagcatgagaacagacactcctaatatacttgggaaaattatataacctctttaaacctcaatttctcaaagtgagggatggtgaacagcagggcgaggatgagaaagaagatgctagtgtaagtaatagtacctccttcacaaagctataatatagattatatgaaattatgtgtaaaatgcatgtaacataatcagaagtgttaggttttactgctactcatgagtagcttatttatttattttttctcattagaagaaaactttaaagcgatgaattgtcttggtgaaaagtattaggagactcttggctatgggtaaaaatgtcagaaaacaatctataggctagagtcagtgcaaaggaagttatgtttttggtagcctaatataaatgtaggtcgtgtttcctgatgtcagcaacattctaagaggcggtcagttactctcacacttggaactgctctacctgactatgtagtgggttttgggagagtcctaaaaaccacatcttataatgtgtcttctataaaatgttccacagagttttttataaaacctttaaatcggccgggtgcggtggctcacgcctgtaatcccaggactttgagaggctgaagggggcagatcacctgaggtcgagagtttgagatcagcctgaccaacatggagaaaccccgtctctactaaaaaaatacaaaattagctgggtgtggtggcacacacctgtaatcccagctactcaggaggctgaggcaggagaatcgcttgaacccaggaggcagaggttgcagtgagccgagactgcgccgttgcactccagccggggcaacaagaacgaaactccatcccaaaaaaaaaaaaaaaaaaaaaaaaaaacctttaaatctttatatgtgatctgtttatgtattgagttctgctcttattgatcatgtgtgtccatagaggcaagatagagcagtcaaattgtgatgaccagtatgagctgcatttgaagttcagctacacagaattttagaaagggatagaagagatattattcacataaatatttaaagactaattggacactatagggacagcatgtaacatggaggtgaggagaaggactcctcccaatgcttcaacaagaacacagctgtgtagataccatctaacgctgcctctttttcagaaaagaatatcctacaaactcaggttttactatcagtatcacaaaataataacattattatgaaataatgtgatttaaacaatatttaaagatatgaaaggtacagtttcaaaatacaaagtgttatacaggtccagccatttagagatagactaatccattatctactaacttctggtttttgcaaatagtatactagaattcatcctgtaagtattaaattttataaatatccaaaatgcctgtattttgccaaaaagtaaagccaccctatttcaaattttttaatctcagtacctacttttaggtaagcccattgtaaccacaaagaaaatacatacagagcagtgttccccagcctttttagcaccaagggacagttttatggaagacaatttttctatggaccagggttggtgggggatggtttggggacaaaactgttccacctcagatcatcaggcattagttagagtctcataaggagcacacaacctagatcccttgcacacgcagttcacaatggggctcaagcttccatgagaatctaatgccgtcactgatctgacaagaggcggagctcaggcgggaatgctcactcgcccgcctcacctcctgctgcatggcctggttcctaacaggccacagactggtaccggtccatagcctgggagttgggaacccctgtatagagcacatacaaaagaaaaacagaaagaaaaaaaaacaggaaaggagaaatgggacaaaataaatacaagacaaacaaacaaacaaaaaaggttaacaaaatggcaatagtaagtcaataattaccttaaatgaaaatagactagactccccaatcaaaagacagagtgactgaatggatttgaaaacaacaacgacaaaagatccaattaaatactgtctacaggagactcactttaagtttaaagacacacataggctgaatgtgataggatgaacaaatgataatctatgcaaatggcaaccaaaagagagcaggagtggctatacttagaatagattttaagtcaaaaactgtcataagagacaaaaaaggacactatataataataatatcagcagaaggaaggctaattcaccaagatgtaacaattttatatgcacccagcatcagtacctctaaatatatgaagcaaacactgatggaactgaagaaagaaatacaatattagaagacttgcatatcccactaaatagcagatagacattcagacagacaaatcaataagaaactatagaccaagtggacctaacggacatacacagaacatcccacccaacagtgacagaattcacatccttctcaaacacacacagaacattctccaggatagatctcatgttacgtcacaaaacaagtttcaataaacctaagattaaaatcataccaggtatcttttctgatcacaatggaatgaaatcaaaaataaataacagaaagaaaactgaaacatttacaaatgtatgaaaattaaatgaaatactcttgaacaatgaataggtcaaataaataaatcaaaagggaaattagaaaatgtctcacgacaaataaaaatgaaaacacaacataccaaaatgaatgcaatacagcaaaagcaattttgaaagagaaatgtatagtaataaacagctgcataagaaaagaagaacgcaaatcaacaacctaacatacctcaagaaactagaaaaaggaaaacaaacttagcccaaagttagcagaaggaagaaataatgtagattagagcagaaataaacagagtaaaaaaaaaatagaaaaacttgaagaaatattttctaaaaagataaacaaaattgacaaactaaaaaaaaaagagaaaaaaactcaaataaataaaataaaaaatggaaaaggagacattacaacctgatggcttcaatgctgaattccaccaaaaatttaaagaacttatgctaatccttgtcaagatcttccaaaaaattaaagaaaaggggatactttcaaactcattttataaggccagcatttccctgacaccaaagccagacaagaatattacaagaaaagaatactacaggccaatatccctgctgaacatagatgcaaaattccttaataaaatactagcaaaccaaattcaacagcatatcaaaaagatcatacaccacaaccaggtaggaagaaggatgtttcaacataaataaatcaattaatgtgctgcactacattgccagaatgcctaggaataaacttaagaaggtgaaagacttgtatgctgaaaactatgaaacattgatgaaaaaaattaaagatgaaaataagtggaaagacgtcccacgtttatgacaggaaaacttaatatcattaaaatgtccatactacccaaaggaatttagagtttcaatgcaatccctatcaaaattccaataacattcttttttctttattttattttatttatttatttatttattttgagacagggtctcattatatcacccaggctggagtgcagtggtgcgatctcagctcactgcaacctccgcctcccgtgctcaggcgatcctcctgcctcagcctcacaagtaactggaactacaggtgcatgctaccaggcccagctaatttttttattgtttgtagagatgaggtctcactatattgcccaggctgatctcaaactcctgggctcaagtgatccacccaccttggccttccaaactgcgaaacttacaggcatgagccactgtgcccgccccagcattttttacagaaatagaaaaaacaattccaaaactcatatggaaacacaaaggatcccaaatagctaaaacaatcttgagaaaaagaacaaagctggaggcatcacacttcttgatttcaaaatatattctgaagcttcagtaattaaaacactaaggtactgtcataaagacagctttatagaccagtggaaagagggcccagaaataaacctgtgcatatatgaccaactgatcttcaatagagatgccaagaacagacaatggggagaggatgatttcttcaataaatagtgttggggcattgtatatccacatacaaaaagaacaaaattaaacccttactgtacaccatacataaaaatcaactcaaaattaattaaagacttaaacgtaagacctgaaactgtaaatccttagaagaaaacgtaggggaaaatcttcatgacattggtctttgcaatgatttcttggatatgacaccaaaagcacaaacaacaaaagcaaaaacagagcaagaggtatactatgtcaaactaaaaaacttctgtacagcaaaggaacaatcaatacagtgaaaaggcaacctgtagaatgagacaaaatatttgcaaaccacatatctgataaggcattaatttccaaaatatataaggaactcctccaacttaagagtaaaaaagcaaacaaactgatttttaaatgagtaaaaaatttgaatagacatttatccaaagaagatatacaactgggcaatagatacataaaaagattgttcaacatcactaatcatagggaaatgagaatgaaaaccataatgagatatctcacacctcttagggtggctattggtttttatttgagggggtttgtttgtttgtttgtttgtttgtttgtttgtttgttttgagacagaatcttgctctgtctcccaggctggatggctattgttttaaaaaaaaaagttacttggtgttattaaggctgtggagaaattggaacccttgtacattgttggtgaaaataaaaaatggtgcagctgtgtatatatatgtatggaaaactgtatagaatgttctcaaaaaaattaaaagtagagttgccatatgatttaataagtccacttctggccatttactcccccaaaattaaaattagaatcttaaagagatatatggaccccatgttcactgcagcaatattcacagtagccaagatgtggaaataacctaaatgtctatcaaaagatgaatggatacagaaaatatggtatatatgtatatatgaatggatacagaaaatgtgagatagatagatagatagatagatagatagatagatagatagatagatataacagaatatcattcagccttaagaaaaaggaagtcctggctgggcgtggtggctcacacctgtaatcccagcactttgggaggccaaggcaggcagatcacttgaggtcaggtgttcgggaccagcctgaccaacatggtaaaaccctgtctctactaaaatacaaaattaaccaggcatggtggtgggtgcctgtaatcccagctactggagaggctgaggtgggagaatcgattgaatccaggaggcagaggttgcagtgagccaagatcgcaccattgcactccagcctgggcaacagagtgagactctatctcaaaaaacaaaaagaaagaaaaagaaaaaggagtcctgccataagtgacaatatagatgaatcttgagaacattatgctaagtgaaataagtcaaccacagaaggcaaatactgcatgattccatttatgtgaggtatcaacaataatcaaactcatagaagcaaagagtagaatgctggttgccaggggctggcaagaggggaatacggggacttgctattcaatgggtataaagttttagtcatgcaagatgggtatacaacgtagtgcttacggttaacaatactgtacacttaaaaatttgagagagtagatctcatgttacctgttcatactacagttagagtattagtcctttttcacactgctgataaagatatacccaagactgggtaatttaaaaaagaaagaggtttaattgggcttacagttccaagtggcttgggaagcctcacagtcatggcagaaggcaaggaagagcaagtcaagtcttacttggatggcagcaggcaaagagagagaacttgtgcaggggaactcctccttttaataccatcaaatctcattagacttattcactatcatgagaacagcatgggaaagacctgcccccatgattgaattactgcccaccaagtccctcccacaacatatgggaattcaagatgagatgtgggtggggacacagcaaaaccagatcaaatagaaatagaaatcaaaatagacaaacaaaaaactagaaagaatctgagagcctatacttcaaggtgttttacctaagagatctgaggaaattacaaacatgatcaccagcactgaaatcttgaacttggatcaaagtaaccctacataaccacaaaatgacagggatataagtctcagagactttaaatgaatataacaggttcttgtagataactcatatacagagatccaaaaatgaaaaacttgttttacatcctattcacaatatgtgtagtacccttttcccaaatacttgactgataaaaatacatacagatttttaacttatccagtctattacagtttatttgccaactcttagttccctcttgtgctacgtttaaatttataagatgagtacagagactttttgaataactaatttaattaatgaattttaaagttaacttttgtagagttttagatacgtcctttggtcatacagtttagaaattacattgaaaagtaatctaatgcaaagttttttgtttttttttttaatttaaaaggtttgagtaaatctttctttctttttttttgaggtggagtctcattctgtcgccaggctgcagtgcagtggtgcgatctcggctcactgcaatctgtgcctcccggggtcaagcgactctcctgcctcagcctccagagtagctgggattacaggcacacgtcaccacacctggctaatttttgcatttttagtagagacggggtttcaccatgttggccagaatggtcttgatctcttgacctcatgatctgcccgcctcagcctcccgaagtgctgggattacaggcgtgagccactgcgcccagccgagtaaatctttctttaaaaattactgaagctgagtttaatatactgtatttatttgcatcaactcaaaattgaattttatgccacctttttggtcagttgtgaattgaaattttataactgaaattgtttacaagattatgttaaagtagggctgagagaatgaattttaaagtatgattcaaggttatagattaaattatgttcttatatattttagtcactttttgaactattacaaatatctagtaaattttttaatgctctgcccctttaattctggtcatgtaatttaggactgaaaggtgagctttatcttggaacaatattatctttcatttatatgatagcaaaaaaattaactatactgcctttattcaaaagtgcttaaaaacaactatatgtttactctctccacttcattattttcttcctcagtgcaaatatgtttatctggaaataatgtatgcattgtagcatgcagaatgtcaagctattttaagagatgcaacataatgcttgctataaactcttatattcagtcctcatttcataaaactctcatgtttaacttgaacatgctttcatgtaaaagctcaacttaaaagtgtgcctgtttggatgataagaaaaaaaagcaaacaaataaaataactacacctatcttgtactctttaaaatatatatgttggtttttaaaaataattgcactaagctaaacatgagaacctctatattagcaacttacattaaaagcaagtcttttttgggaaagcaaaataaaattaaaagacacatgattttagatcactgatctgagtacacagatctaatctctttgccagggttgtgtatactgtacacgacatttattttatttttttttttttgcactcacttattttgatccagtggatcttgacctattatcaagagtgagtgaatattgctagaagtggtcacttcagtatgacttaatctgaagacagagaaaaactggttataaaagaggaaatatattagaaaggagagtatttttgtatctagcaacctggaatatgaatgtaaaagagaataaacagttcaacacagaatgataaagggtgccattgagagggtcttctggagttggttttgcttcattcaactatgaaatgactacatgtattcatttatccctcccctccctcattttgagggtataataaatgtgtttctcctttttctcctctttcttcaactctatctccttgaaagagaataaacaactaaaaacaatgctgcacccccactcaccttgataagcagcatgagtctattaaattaagcatgcttgacactcaaacaccaattttagggacagagtgctcaaaatagaaagcacaatggtgacatcctgttaccgtctctttgtgcccttggactcataaataaagttctgcaggtttctgtgctcccttgatacaaaataaagaaaagtgaatgagttagaacaagctctggcagccatcagtaatgttgcaccccattgctgcaggacaggagacatccaattatggagcaaggtcagcctcagtctctaccagtattttctctggtggtcaagagaccctcaccccctcaccaccaccaccaccaccaccacgattcccttctacctgatggtgctccgggactttatttttggatccttcactgcttgacttaagaggaggaagacatgataggccagtcagtcttggctgggttgtgggaaaagtgagaggacagaaccagattggtcagtttgtgaatcttgtgatcagctacttttagaatttatttgttgttaagtttgaccaacaaatttccatatccttcatgttttctcacaaagatctttaaattgcctttcccagcttcccacctaaatacattcaaccatcataacacattccaaaatacagtggttgcccatggtttgcccaatactgggcaataggcactcagatcccagttagtgaccaatatacctatgggacacaaatcatatcaatgaggcacagctgcagggtgcatgtctactaaggatactgctcatctgaaccctcagactatacattctggtaccttagttctgtctcttggtgccctttcctgcgggtaacccacattcttattctctctccatgcggcatgggcactctctctcctgcctgagtcatagttcctggagcagactccacccccatgtttcagatcctgcctgagtccactgaatgaaagcaacaactcctgcgtgtcactcacaattccctggatgatactaaaaagcaatctttctctcattttcgaaacccctttgagatattaatgacttcctagatttttttcaggacttagagattatttcagaaataatcatataataagaagcattttgaattggagactcaaattgctctttagatcatactatataatcttaatgatgatgacgatgataatagtagctaccattgaacaaatgcctactatgctaggtgccttctatcttaaccatggttaattctcaggggcagtcctcaaaagttaggatattgttcctatttctcaggtgggggaaatgactttcagcaggagtaactatttttattcatcttatagctttaaattggcagctagattttgaccccatgtctgactcgaatttcattttatttccacaacaccattcactgcgtagagataagaactgtgagctggtctaataattttttcttcctgcaatagaagtccttttctaaaatttgggtcaactctcagcactcgtaaaaatatgcatataaaaagggaaagaaatggaggaaaatattttcccattaaatactaagacctactatacactaagctacagtatttaaagcacacaatactaggaccaattggatggattatgataaagagactagacactgacccatacataaaagaacttggaatattatagaggaaacacgaagaattaatgaaaaaaggaaaataaatgatgttgcattaattgaatttcaatatttgaaaaagtaaaatagctttccctcctgaaacaaacaaaaaattcagggagatattggatctcaatgaaaagaacatttaaatatattaaaaaacaaaactttaaatatattacaggaatatgaagataatacctttatgatatctgggtaacaaaaggcaaaccacgtaaattaagtaaagcaggattttttttaagtaactaaactggtacaatttataaagtacacatactcctttgaaaaagtaggtctcatgtgaatctgctcaaattccagggctgtattcactttcaccaaacactaatgacctgaggctattgtatttttctagttttcctgttaaaaagagacatgagagtgttgactctcaggtgtgagatcttgactgatcccacacctagcccaactggaggcttaaggctactcatcacagagtccttctggagccaagataaatgcctatgaatctcaacttttattcacagctttcaatattagattttttaatattagattttaatatttttcaatattagatttcatcatttcctgtgcccatttccctagctcaagggttcacttatctttgataagtttattggctagatgtatgtacgatgactcactctccatcacataaaacatacaattttgacagttgataaaaagatgttcgcataaactataatcatataattaaatatgtaccagaaacctaaaaaatagggaagagggaagctgatagtattttactcacatttaactaaaaagccatacattttaaatctatgaggtaagaagaaaaatcaggaaatctgcctgaacccattagtgactattcatgtaggatttttttttttaattttattttttttgagacaggctgtggcccaggctggagtgcagtggcacgatctcagctcactgcaacctctgcctcccgggttcaagcgattcttctgcctcagcctcctgagtagctgggattagaggcacctgccaccacacctggctaatttttgtatttttagtagagatggggtttcaccatgttggccaagctggtctcgaattcctgaccttgtgacccacccatctctgcctcccaaagtgctgggattacaggcgtgagccaccacgcctggcctcatgtagaattttatggtcacaagcctgtagttctagcagggaaactcaacacataaaaaggaggcctttaaatgcattgtcaagaatgacgaaaggagctaagtatcattatattctgatcaaaagaaaaggcaagtgtccatttccaatctctctttctctctctctctctctcacacacacaccccccagcagatttgtaaagaaaggtaaataaatcccccatacaaaaagtttccttttttccccacttgggtctgagagttgttcagtttaacctgagttgccattagtgtccttcgaagctataaattttgcttttccatgcaattgtttcaaaacaaagaaaatctgtgactttaaaattactttagagccaagcatggtggcgggtgcctggggtcacagctactttggacactgaggcaggagcattgttttgagcccaggagttctgcgtggtagtgcactgtgctgatagggtagtcgcactaagtttggcgtcaatatggttaattcctgggagcgggaatcatcagtttgcctaaggaggggtgaaccaagccaagtgagaaacggagcaggtcaaaatttccattctgatcggcagtgggttccacctgtgaatagccactgcactccagtctggataccatagcaagaccctgtctctttaaaaaaaaaaaaaaaaaaaaatggctttagaagcaattttacaccctaacttaccaatataggtagcggtccgactttatcgccacaggaggaaaaaataaaaagcagagtaaaacttacagagcaatggtagatacaatacgatcaatacaatcttcaaacccaacttcactgagcatgagtttctacacataaaagagattctttcattatttcttttttaattatttatttatttatttatttttgagacacagtctaactctgatgccctggctttgagtgcagtggcgtgaacacaactctctgcagccttaaccttctgggctcaagggattctcccacctcagcctcctgagtagctgggaccacagacaagcgccatcacacctggctaattttttaaattttatgtagagacaagatctccctgttgcccaggatggttggtctagaattcctgggctcaagcgatcctcccacctcgggcaccaaaagtgctggaattacaaggcataagccatcataaccggtccaagaaaatcttttagaaaaccccatcaaacaaatcaccatactatttaactgtaagtccaaacaatagtttcaatcgtaatatttgaagcaactagtataaaaagagaaactcataagctagcttacatttctgttgtcaaagagtaatttatccttgctggagttggtttggaggtattaatagccggaattatcccaacaatattctggcaagaaactatacacgtactttctgatgtgctctgatgtggccacagtctggcgctgagagtagctccaacatgagggactgaagcaaaagggtttcccaaagaagcactgtgccccggagactggaaggagaatttgaggaagacattaggatgaggcatctcaggggtgtaagagagagaccctggaaggcatttggggccatgacttaattataagctaggaattgcgtgtgtagaatttacaaagtaaacaaaatggcagccgagggtggggatagttcacacccttagtaaaggctcgacattatagaatctgcctcatactaggattcccagtagcttttctggaaataggtctccttcctctcctgccagccctaaaataatattggtaacacacacaccaacttctagagagcactcacaaaaaaagttgtcaccgccaagtgacctcactgcttctccctggagagctttgcagacagaaaatagctctgtgtctttataaacaaatcactctgtgaatggcagtgggtacacaaacatgtcgattctcttccagagttcttactcgctcaattgccaggtttgcttctattttggttacagaattaaaatgtaattagttgtgtttttaatgagtccaaatgtgacacattaagattcagtaattactctaaaatgataagctgtgattgaatgtccccataaacaagggacatttaaaggcagtaccatttcttgctcagttgttactgcttttaaaaccgtcactctttcctgggtgaatacagttttaggatttaaatgattacgctggattattgcacatatttacagtcagagccagctataccgacatatttaaagtgtgtacgttctttgatcatgtggccatgtctacctaagaacctaataactgactttactgaatgttggctgtccaggttagtacctcattatgacttactggcttttaagacacgtttattttatgtggcatcagtttttctcttcaacctgatgcaagacctcactgctatttctgaggttctttatgtccttagtgtttggcagggctcacatcaggtctagaaaagtggtgctagaggttcaagatccaatacaacaatggcagcagtaattgatgcacttgccccatacggaaatctgatctcttaacccacctgtttcctaggctaactgaatcagcagcatgtcagtagctgccaatgctgatcaatttcctagtgacattggtaacttaaaaaacattgaaatagttaagttcgttgtagaagtaagcctttcatcctacagcaaatcaaaaacaaacaaaatggataaatgttttctgataacttttaaaacagtttacctaagaggaggaattgtaaaaacttaaacataaattgagatcatcccacctgattttttaatattcgtaggaagcctgttcatgatattccagtcaactactctagaatcctattttggtatctcagtatctcgtgcagcagtgaatagcactgctcaatattttagaggcttcatatttccttagagtcacaattgtcaccctaaaatttagatctaataatcctactactgtcctgtgtaggaaaaaatacagaaagcatatacttcttatttcccagccttcaagtatgtgaagactgctatcaagaccactgtgtcttactggccaggcgcagtggctcacgcccgtaatcccagcactttgggaggccgaggtgggcggatcacgaggtcaggagatcgagaccatcctggctaacacggtgaaaccccatttctactaaaaataaaaaaacttatctgggtgtggtggcgggtgcctgtagtcccagctactcgggaggctgaggcaggagaatggcatgaacccgggaggcggagcttgcagtgagctgagatcaggccactgcacaccagcctgggcgacaaagcgagactccatctcaaaaaaaaaaaaatccccgcttccaacagcagttctcctggaaccctaccttcccctgaattttgtcatatttatcaatgcctttcttatggcaaccagaagtatatagagcagttcagttcacaaagggctgtaaatacagtaggacaatacctatctcactttactttggacaaccagatgcttcaaaacttgctgatggtagattaacttttcatgtaactttatttattttactgttggcacacacggcatttttgtgtaaagttttctaatgatttttacatgaaatgatgtccagttataaatctctattctataccttgaatttaaaccaacaatttttttcacttaatcctattgtattatgtggtgttgtttttattattctaatctatttaaagcatattaatctcactctgaaagctgtataaaaacctctaaatctgggccgggcgaagtcgctcacgcttgtaaatcccagtactttgggaagctgaggtgggcagatcactagaggccaggagttcaagaccagcctggccaacatggtgaagccccgtctctactaaaaatagaaacattatctgggcgtggtggcacaggcttgtaatcccaactacttgggaggctgagccaggagaatcgcccaggagacagaggttgcagtgagctgagataatgtcactcactgcactccagcctgagcaacaaagtgagaccccgtctcaaaaaaaaaaaaaaaaaaaaaaaaaaaaaaaagcctctaagtttggttcatctgaaaatttcatgagtctgcttactcttacaagtccttgctcataatattgaacaaaaatcaccaagaatagacatgtgacacatacaccaacagaagtctctccccagcagttcaataagtggaaggtactctagctagcatctccatcgttcaactgtaccccagtatatcaacaaacacattatgagtggttcaaatgaatgcttttctgaaatgatgccatcctcaatggggaagtttcccagtctatcaatctccatgcagcataatttgtagaagtcctacctttcatttctagatgctaatcgatcttctattcaatggaagatctagcctactggtgtctcattttttattcttcctacaatttagaaaatcagatcagcataagaactttatttttaacaaatattaatataaaagtattacgtgtttttctactgcccatatctgttctgtccaagccatgtacattcatgttaaataaataccgtcttttaaaacataaatagcatggttactccacattgactcctgatgtcccaagatgttcaagatgcagtaaggagaaatattattttaaaacaattcaaagggagtgaaaatggtagcacacaaaggaggcagcatttcctgcttctcacaagaccatctgcctgtattgtgggcaagattttttaaaaatcctaactgaaaagaaaataatgttaagagacatatgcccatgtttacaagctgagggaaattgacaagtgtgtctgtttcgccagtatttttacagtcaactgttatacataatggggaaaattaaaatcggtaattacttttctagtctgccattgttttaaatgtgcttggaattttccttaagcatccattccaagtaattatttgtaataggccagaacacttaaagggttgtagggatggatacacagctattttacaaagtgaaatactttgacaataacaaattatttttcctcctttctctccccaatgttggctgagttatgtttatacctcactttgtagataatccttctagctacactttttttaggcacagccattataaaaatcttctgtttgggcttggcactgcttagaactagaaattgctatttgctgcctgccaattacagaataatttaaggtttgatgctcccaggcacagtttcttgaaatacacagaaaaaaatatattaaggtggatgcataatattttttctgcattgcatagcttcaattgcctgtatagaattatatccaaattgctaaacaaatcaattggagaaaaattatgtcttctaggaaagtgttttgtaatggttttactactctttcttttgataagatcatagcaaatattttacaaaaattttatattatttgcaactgaatgatttcaatctatgaaatgtgatgggtataaatattgatataattttaacataaaatttaaacttctaggaaataatagaggaagatgtgatttttttaaaatcaatttggaataattaagaagaaaagaaaaaagagagttaattaagtttcccggatcttttcaagtctaaaatgcaataatttttcatctttgtatattcgtatctgaattatccatcatttgcagtacgaagcaggaaagcggtaaagcaaagtaaatttgtgatttaaaaggatcaagtatatggttgaagactcaaaaagctttttatttgggacagtagaaggaaatgtgctgattatcatgagaacaacaaaaaagagaaatgagttatttatgtaaccctgtcatcatgcctacaacacctcgaagggcagtcaggcatagtctgttatcaggaaaagcaagcaaacaaaagcctttatatatatatatatataactaatcacaaacatgctcagactccagaagatggtaaaataaaataaaataaaataattttattgacttctttcacctaggtgccttggttgcactccctggaaaccattcttcgcattccccacttacttctcttttcttttctttttttttctttttcttttttttttttttttgagacagagtcttactctgtcgccccaggctggagtgcggtggtgccatctcggctcatggcaacctccgcctcccaggttcaagctattctcctgcctcagcctcctaagtagctgggattacagatgcgcgccaccatgctcggctgatttttgtatttttagtagagatggggtttcaccatgttggtcaggctggtctccccacttttcttaattcacccctgaaatacactacccaaacacgtagcaactgaggtctggaaacttcattcttgacttcttctaaggaaggccactttcttcaaaatacagcaagacaaacacatctagctcctagcatgacttcagtgtgaaaaggctgggcttgggagagcagcaggtagacatgcctattaacattgtgctgccatgtttactttttttttgtttacttaaatcatggacagaaagccaagtgtataagtgaaaacccaagggacaatgacatggggtagactgcagaccaagaataagcaggaagttaaataccaagatattcccccaaaataaaccagatagcttggtttatatggaagaaaataaaccagagtaccactaacataagcatgacagaaggttttacacaaaactttagcagaagtgggtccaaatttcagctagtttcaggaatagttggtcgaggatggttctccaaagagggtggaattgtgctgttgatcagctgccctcacatgagcgatttgcattttcttggcgagaaatagtcgctgaagtcaagcagaagagtacgtgagaaggaatagctgtgagaccaggacaagccaaggccacagtgggatattctcagtccgtctgggtctctagatttacaaagaagcatgttgaatctgtagaggcaaatgggaagctcccccttcaccctctaaaggttagctgaaaatgagtaaatgacaagagggggattaataggaggaaaggacatagagaaggtaattaacatgcttagggacaggggaatcacaggaggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaagggttttcctagtcagataaggaaattccggttctggtacagtggctcacacctgtaatcccagcactttgggaggctgaggcgggaggattgcttgagcccaggagttcaagaccaccctggccaacatagggagaccctgtctctacaaaaaaaaaaaaaaaaaaaaaaaattagttgggcattgtagtgcatgcctgtggtcccaggttctcaggaggctgaggtgggaagaattgcttaagccagggaggtagagaggctgcagtgagctatgatcgctcaactgcactccagcctgggtgacagagaaagaccctgtctctaaaaaaacaaaaaataaaattccagcaagagtagctcccaatgcttcaggaaagaaaagagatcagagtggggcttgggagggaacactggagagaccttggttctgaggcttatttctgatgcctttaatttcctttaattcaaagcatgccaaagagccatatttttggaggagtattttctgagccccaagaactcctcacaatgcaaaatggatgcctggctttcatttttttaaaatgatttatttaccttaaaaataaacttggattcatttgatcttcataatccctgtagataatttaggcttccaaaggaaacatggtctctattggcctaattaccaataaccaagttaaattccatttctgtacagaatttttttaaaatttacctcacaatctagaaagaggagaaaaaaataccttaaaaattaattattttcaaagccatgtatatgcagatttggtcatggcttattcagaacacattagaattattttaaattctaagtatcctcaatggtgaacttaaaatttcattctagggggaggggggcatggttaatgagtagaaaaaaatagaaagaatgaataagacctactatttgatagcacaacagagtgactatagtcaataatgactgaattgtacattttaagataactgaaagagtgtgattggattgtttgtaacacaaaggataaatacttgaggggatggattccccattctccatgatgtgcttatttcacattgcatgcctgcatcaaaacatctcatgtacccccataagtatatatacctattgtatacccagaaaattattttaataaaataaaaataaaataaatgaaataaaattttattctagccattccaggaaaaaaaaaaagccccattttgcaaagatgattataaccatatatatcatatgattatcaccttgttttcatacacacaagcatatatgtatgtatatatacatatatatttacacacacacacacatatacacacacacacatatatatatgtgtgtgtgtgtatatatatacagttgacccttggacaatgcaggggttagggctatgtcctgcacagtcaaaaatctgcatataacattggactccccaaaattttaaccactaatagcctaccgttgactggaaaccttacccataacataaacaatcgactaccacatattttgtatgttatgtatattatatattgtaatcttacagtaagctacacaaaagaaaatgttattaagaaaatcataatggccaagcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaagaggcggaggttgcagtgagccgagaagaaccattgcactccagcctgggcaataagagcgaaactccgtctaaaaaaaaagaaaagaaaaaagaaagaaaatcataatgaaaagaaaaatatatttactagtcattaagtagaaatggatcatcatgaaagtcttcatccttcctgtcttcacaatgagtaggctgaggaagaagagacgaggttggtcttgctgtcccaggggtgaaagaggcagaagaaaatccatgtataagtggactcacacagttcaaacctgtgttgttcaaggatcaactgtgtgtatatatatatatatatattttttttttttaggtttattgcaggaacaaaatcctctctccaaagctataatcctgactggctcaagatgtcttaagaaacttagaaacacagctaggaataaattacagcccaggctagttggttgttctcccggaatgagcgaattcaaaaggaacctggttatttagcaagaaatagactcagtgacctcagcagcattctaatgcatggaaaggtcagagaggtttcgtaccactctgctgggtcagatggaagccagagaagctgttggggtctccttgaaggttgaccctgggctgcaggtcaggaaacccaagtaggattccaggaatggattgctaagaagcttcgaggagaatggcttccacccatgactgagaattgaattgaggtccaggtagaatgggtagtacctggtcacagcccataagaaataagaagaggctatgatttgaattggtattaataacaaagaagaaaagcagcatttacttcgggcacaaggccagccagcctgctctcagaagctaaatgcaagtgacattttcttgtcaaatcccaacttttacccatcaaaggcttggggagaaagggaatccattgcaatgagttggttctgtagatagccctgcagaatcctggggggtgtttcacacgccagagaccaggatgggttgcggaaagcagttaactaccaagtatagtaagggaggcacagtaactcacctggaattgactttgcaagctgaagactgttttcaactgtgactgtgccattaggattaatgcaattcatacagttggctagcacatcagataaatatgatgaattgtccttatatccttagtccagtgagaactggcttttccatcacagcttaagctatacacatagagaggcaaaaaaaaaaaaaaaaaaaaaaaaaaaaagaccttacagttttgtttattgtgcttatcacaagtgctggaaactcacattttcattgctaatagccctctttgaaagtttgttgacatttcagctgatctttaatgtgctctactgttataatacccttgggcaaagtcagtttccaataggaaaatagacagcttctgggtacccctgtggaagctgcacaaacacaaacagactggcaccccagcctgcaatacctggtgagctctgctctgtccgaatcacagaagggtggcagaatatataacctcaaagcatgccactttggcataaggattatgttgaagtaaaggctcttgaaaaatagcagatacaagaagagcactttgaccttcctttttcttcctaaaagcaggagataaatctccaggggaaagttgttgtccctgtattgggaggaagaaacattcttatcaccagagatagggagtgaaggtcaagagaaatccgtaccaaaaaactttgttaaattaaccttatctgtctcttcacttttctacaattaactgctctggcccaagcctctttgtcttgccatgttttcacaaggtgctcctcttcatccaacttaggatataagcatctgactctaactgcttctttgggtcttcattttcctatgtgaattcccatgtccatttaaaatctgtatactcctatcttggtaattatctgatagcgatttaattctcaggcccagccgaggactctcagagggcagagagaaagttgtgccttccaggatcactgtatttgggagcctggaagacgaagaatggagcccagtaaatagagagggaaggaaagacatttaaacaggttcctaaagagaatgtgaggacacgtaagaacaacagtaagaaaaagtacagaaagaaaaatttacaatctattctacagagcaaattgaggtatttcttctgtaatagggaaagaggaaagagaagattcatgactgaccatcagtaggctttatagtggagagagaattgtccaaacctccgtataatcaagcacatatcctgattcttagaatatatgttccaaactaaattaagaaagggtgatgctggacagaagcagttattaattctggggtcaacaggataaaaatagtcagaaatgaacgttgtggtttgggaatataagcagctgaattcaaaataagaattctaatagaaagtgttaaatcaaagagcagttcataaagtcagagctagaccttgggtggggggaagagcaattcaaaaatttagagcagcatgtatcttaaaaataaattttattgaaaaatgagaacacatggacacagggaggggaacaacatacaaggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaggaggcagaggttgtagtgagccaaggccacgccattgcactccaggcagggcgagaagagtgaaactctgtctcaaataataataacaataataaaataaatctctccttttcattatttatagaaaatcatagtattttggcacattaaattgaacatatttctttaagtaattaaatgtacgcctatcataatgtattcctcctggtacttaactatcatagattattagcagtttagtgtttaaagggaactcaggactgagagttttaaaaacttagactcacagtaagaaagtcatctcatgttgatgaagtataaatatgcacatacacacacagacacgtcacatgcaggtacataactaaaatgaaagcttcctgaaataatacttatttacactttgtacagaatcgaatgcactttatttcctagtctttgcattttaaaaatatacttattttttttaatgctgctcctggttccccaaattgaaattactatctaccaatgtatctcaatttacagtttggaaaacactgccttagggaatagctagtctaattttgcacctgagaaacgtagagatttagggaatattcccaaggtcacgtagtatgtggcaaagcaagcctgtgctgtcttctaagttctggcgtaatgagttttccccaatcttacattgttacattgttttcaagatgaatggtcatgtatagtgtactctttgcctctcaaatttgatgaagtaagcattattccgttgctacgtgtcttgctcactttgcgttttcttagtttcataggaagcatcagttgtgctaagttttatttgtgtgttccattgtctcttccccctaaactgaaagcttcctgagaatagtgtgtattcttatcaatatcccctaaaccaagctgagtagtgtgaatgattgaatccttagaaagacaagctcatgtagtcaaatagtctaaattacatgagtgggacaaaaatatcagcatccaggtagccacagatgctcttctttccttctaagaaatacgattctcattccatacctagatgatgggttgataaggtgcagcagaccaccatggcacacgttcacctatgtcacaaacctgcatgtcctgcacatgtatcctgaaactttaaattttaaaaaaggaaatatcaattctattggttatgctgattagagtaataagtggagagggaattgagaagttctaagacaagctgtgttagtatcctagggctgcagcaacaaagtaccataaacagagtagcctaaagcaacaaaaatttactctctcaaggttctagaggccagaagcctgaaatcaaggtatcagcagggccatgatctctctcgtagcttctggtggttgccggaaacccttggtgttcttggcttgtagacacatcgctccaacctcagcctctcttgtcacgtggcattctctctgtgttttctgtgtccaaatttcccccttcctattaggacactagccattggattagggcccatcttaatcaagtatgacttgattacatctgcaaaggtcatatcgagaagtaccaggggttagaacttgaaaatatctttttggaagacacagttctacccaccacagaagctacaccaatttacatgaaaaagaacctaagtagatctagaagagttggagagagaaatgggatagaagggagatgagcaggaagacatgaaagcaaacaaatgagttatcttcaggggagaaaagtgcttgtccagtgtactatggagagacgcataaatgaagatgactttaatacattctgctttgcatcatgcaacataactttttttcttttggtgcctctcacagagacctctgtaaatcctaaattatcttttaagactttgttcaagtcagattttttagagttatttcagatgttatgttattgcaggaagcagctcacaagtgacctagcattaaagataataaaagctaatgtttttatgtgagtagaagatatagcattgcatttaaactatagtttcaccattatacagaaggaaaagaagacagcaagcagaagagacaataatgatatattgaccttactgaaagatgatgacataaagcagtaggatttatcattttttgtaagttactgaacattgattcagtgttatgcatcttgttcttctatatattaagcaattatgtttatttctagcactgaaaagcatagttattttcagccaataattgctatttgaatgctatagttaatgtttttataatttttagatgacaattttattttaattaactctcttagaaacaatcatttatttatttgctcagcaatatgtgttcagtatccaaagtgtgttagacacaattcagtatatccgtcccctatatcgagagtctagttagagtgagttaacaaaagcttttattcatgggaatttatagtataaaagtgtacaatagtataaaaaggctgaaagatttctatagtgatttcactatgaagagatctctctgatatttttcttccctttcaccttatccagtctccaacgtttctgtaaaaaacagctacacccacttttttcttcctgtcaggtgaatccagatagtgcagcaaagttgagccaccgacactgaatttcccaccacaagtgaaacagcagaaaaggctttccaagttcactgtagggaaaataaaagccatgtgatatttattgcacatccaagtatatggattaagattaattcctctggagcaataatgatcacactttttaaatcttacaactcgttgatagtcatcaaaattgaagatccaaaaagcttttatttttatgagttttacatatcagaatttcatgtattagaaattaaaactgacaaactttaaatatttattttaagacaaatgatatactttaaatattaatttaagacaacattaaaaaccctctacttattagcataacatgcttttattttttaaaaaaactacattattccaaaacaaaaaaagattaatgagaagagtagtgttgttccattacacacccatgagtgaatgagagtgaaaaaggaaattgatgtcttaatattattatgaaaattatttggtccaatagttaatggatcccctgaaaggtattcagaacccccagttgtctcctggccacatttagagaatttcagccctagaatgttctgatatgtagtggaggaaattgattctatagtacagaatcagagggcaactcactggcctgctccccacctcagctatcatatgatgcacagtccctgaccaagtggatcggaaatgtctcctgttgtaggtcaaggtatccctgagaaccacaaactgagatatggacaaaagagcaaaagcgccgtgcacatatcttgagatgcaggttaaagaacaaaacaagaatgcatgtattttatctcaggacactaagtctccaaagaatggcttgtgatgggggtacagacttgacccaagaattactgactataatcaaaccacagtttaacagaggtgctatttatagtgaaaaattttcccccaagcaagaattccatagtaaagtaagatcacagttgcacactgcaaatctttaaaagaaaattccagaatttatagcttacttagcctacttagctacttgctttgctcatatataccagttctttcaactaccacaaaaataataactatttgaatatactcaataaacaggcattgtgaaatttgaattttacaacatagaatttggttactgttcctgttaaaacacaaaatacatgagtgaatatttatgtgtatatttttcaataatgttttccaaatgacctttggagaatatctcaagatgattatttctttggcagggggcaaaaaaaaaaaaaagctatcagtgagataagcacatcaatcgaactgttttcatttgagccatgtttaaatgagctaggatgcaaaatagaaattctggaaatatccaaaagaaagatgtacatgtcctctgatttctcctaagtctggacagaattggcagcagaggctctaatgaaatcttgcaattagtctgagaagcccattcagagagcttcactgtgttcagccttctgccgctgacacccttgcctgaagacacatgcccatatcgaagcacatgcagatgcctttcctcatacctagaccctgaaatgaccatggaccgcaggattctcatgtgagatttcagtttactgcttaatttttcatcttgattggacttttcatccatcatatcaggaaaagctgaatatacagacccagacatagataggtttggggacaggaagaagatttaattctacttagattgatcccattttttcttttcttttctagaaatgagtgagatcatttgctgatcctgaggtgtggagggaaaaagtcttggctagaggtgtaagagaatgtgtggaagatggaattgactaaagaaagtgatagggttgtcctgcaggtctgaggacccaggtgatattcatggtctccatgtaacgcataactggtcagcaccttttgtttgcttgtttttctccaagttttactgcttagatgcggtaaaataacatctggcattcccagagttggttttccaagtaatgtcacttactgaggcaggaaggagaaaaggtgtttgaggtttgaagagacaggggaaaaagtctgttaagagaaaaggagtgaaagtgaccagaaataagttagtaggattgacaggaactaaatgggttagcatgggttagcagagaatgagatgtaaactctgttggggttttgctgacaaatacgatggagagagctgaagttgtttgtttgtttgtttgtttctcaaagatgtgataattacagtgaaccttggaatctaaactaatgaagaaaaggagtgaggacaagagagtgaaaaagtgatagtcaatgaattgaaggtcccaggagaagaaatactgtatttgagaaccagagtaaatgaaatggaaaattaaaggcagtggtcagaagtcagcataactagaataaaagtttgaaaagataatgactaagtcaagggtatcaccaggggagtaggtggctgaagtgcaatcggatgaaaaaacagtgggaaacgagatgctcaaagaaatgggaggttcgtaggtcactgtggtccagaattgcaatgattatgtattcagttccggttaaccaagaaattaagcattttgcaattctaaaatcatcagttgatatactaaaattaaagtctaaaatgccatgaacattatgttagatacatatatattaaatggaaatcaaattgtatacgtaaaaaaagatataaagaagaaatatagggctagacatagtgtcttatgcctataatctcagcactttgggaagccgaggtgggaggattgcttgaactcaggagttggagaccagtctggacaacatgaggagactctgtctctaaaagaaaattaaaaattagccaggtgtggtgtcatgcacctgtggtcccagctgcttggaaggctgagatggaaggattgcttgagccttggaggttgaggctgcagtgacagatgtttgcaccactgtactttagcctaagtgatagagtgagactgtctcaaataaataaaccaataggacatattaataaatactgtgatcttaagcaaagacgctttaactttctagagcttagttttctcatctgtatcacgagtaatttgaattaaattatctagaagttaattctttgcctgaaatggtttgtttcctttatccaatattactcattgattataatgatcaccaaaaaatgaatacttacgtgaatactagagaaaaaatattgcttaattttgaaaatacaaattgcttatttgtagaagctattttggttttatttgtatgtttatttaaagtttgcgagggaaccagggttatcaggatcactctgatctgaaatctgagatttgggtaatctcacttctatccaaaaatctctaggacatcaagctcatcaaggtcttcagatgctcatgatgcattaattgccctttgagaataactgcctaagagatggatgtttatattgattttatggtagatattttcttcttcatgggagtggaattccttttacaggttgattcacaaacctagagccaaaaatataactgaactattacagatttaaagtatagattgcataattttgtaaaaatattatcatacaaattctaacatatcgtgagctgaattatactaccacaactaaaactcaattacttataggagtcagacgtatattctaataagacagacactgaaattgctatttttgtctgctggccaaattaactcccaactcatcagtttgcctcccattccctaaagccttgtgcatatgaattacctggcactattgctaaatacagatttttttgcagtaagtgtagggtggaatctgtaattccacatttctaacaaggtcccaggtgtgtcagtgcaacacatctaaggaccacactgaacataactctatacaaaaaggctccactttttattaaactgtgattctgaaaacccaagtagaaatcaggtttttaaaaacttatcattcctttctttggctgttgagacttgtatttctccatgccatatcagacaaattgcatttacctggttccctctgaattagcaatcttaggaacttcagctactctcagattctattccgttatttcagagttcccagtggttggctcaagtgtgagtgcacattcaggttttccagttgcctcatagcgtctttccatgaccttctcccttattccagctcctgcttgggtgtctctggcaccttcttaggacagatgtgggttgtccaatgctcaggacactgaatccagctcaagtacccaccatgagtttgatgcaaggcaagcgagccccaaagtggggcttagcccatgagggttcttggcttctcccaggaaagaatttaagggcaagccaatggtagggtagaagaaaacagctcttatggaagtggccgtgttacagttctgtgattgctcccacagagcagggctaccccacaggcagtgtgctgagagtagcaactcggggcagttctgcagtcatgtttataccgaccttgaattacatgtagattaaggagcagcttatgcagacatttctagaaaaggggtagtaactttggggtcatcaggtcattgccatgggaaggggtggtaacccccaggtgttgccatggcgatggtaaactgacagggcatgctggtgggtgtgtcttatggaaagctactcctgccccagtcctgttttagctagtcctcaacttggttcaggatctgagccccacctctggagtcgagtcccagttggtacctcaacttcaagtgaagaaagtcacttaattcagttttttgttgcccccttaccaataacttgaaaccatttgagtggcctctcatcctattcaaaactactcctttcccttaagcctaaaacattatccttggaataagcctcagcacctcgactctctccttcctttaggctcagagaactgatgactacttcatgccaatacatccttggcaagccacctagtaggctgccattcccacagcaagcccagcagaaccatcagagtcatggagtggttatagtttaggctcttaagttggaattcccaaggacactataacatagtgttcctgcatgggtgagggaaaaataataactggtttttatggagggctaggagaggtagatgaattacctggtgcaaagccggagtcagcatctgtaactgatgagtgagcaggacaagttagagttctatgaggaagctttatgccgtcactggcaaaatttgaggcagcaaaatgcaaaggaactcaataaatggtgagatgattaaccaatgaggtggtactgactccagcagtggtgttattgaaagttcaggtatattcaattataacacattttaaatcttggattgcctgaaatcagcctgccaaatatgagaataatccaggcagacaaggacaaagaacattacacaataatgatactaataggcagtgtcctgtacattgtaattgtacaatagtgacagtaataggcagtgttttccagcatcaactggagtatcatttcctatcccaagtaagttaaacacaggatgagctcaacatcctaaggtccagaggagagtggacggtagtgagttatgctgtctccctgtggtgcccagggactctctctctgtcaaagatgctgtatctaattacctaggctctttctttctcctttcctcctcctttcctccctctctccctccttctctctctctgtctctctctttctttctttatgccctagaaataagtctttttcttctttcccagaaatcatggtgataagtagaagcctgcatgcaggaaattattgaatataacaaaaaaacatagttggtgaagttaactcaagacaaaaattatatacaaagaggtaattgcatatagattagagaagtccagtgtattccctttttgtaaaacgccttctgaatcgagtatcttttgattccatacaattctgtctcccctcacatctgacctattcatgtcagagatctcctacctggctcctttttcatctagtaattaatttatatccctgtcctaacttctatctcctgctcccctcaacattatatctctttttataactaggatatactcaaatgaaaaaatccatgtatcttactatcttctgccttcttctaaatagttgtgcttccttttgatctatttatttgctacaccaggaatatttgacatttcctggagaagtaggaatctcttgtatgctcatttgaaatgagctagtgtggttatttaacaaatatgcagagcaacaatgcacaagatgatcaaaagatatacgtggagaaggaagttctctatttcacaccactgagttacattttaagcatggggcttgtgaactaataccactgttcaccttctcaaaagggcatggtatttaggaatggcattattacagttttctacagttttccaatagaagacattaaataaatgagagaacatttctattgggcaatattaaaacctttacttccacatccactgctttcgccagcttgaacagattagttattcccagtagattattctcattggtaattctgtaataaaagattctagatattgtgcattttcatcactggcattacaatttttatttcagaatcttggtcatcgaatattcattatctaattataataaaaatgcatgattcccttaggaatgcctataactaaatgaatatgaactttattaaaggaattaaattaggagattaaaattattcaaagggggtaacaactttattcttaaagaactgtaggattgcaatactaggaaagaaagagaataggaaaggcaacagaaaagtagtaaaaagaaacagaaacaaaacagatagatccctgatgtgctatgatggggaatagagtattaatttaattattcagttataaataaactaaagcctaagcctagtaaattatgtgctccttgaagattagagttaggactgattaatctttgcattccccaccagaccaggcagtgcctggaatgtagtggacactcaataaatttttgttgaattaataaggaagcaaattctatatgaaaatgataacaagtttatgagtactttttcaagtcagtttgcagatacaagtttaaggaaattcatactcggatatagttagaatgtgtatactgaattagaatgttagtctatgtgctttgggaattaattttgaagctcaggaagctatgcaagaggcagccaagctcagaggaagggtgagagacttgatcagctgcccctccctgtcttgaactatttcctgttatagatggaaatcatccttcattacctgggaaaaagtatgagcccaaagcagaattagccttctttatacatgtgttgaatttgtgttcccatcatattaagtattaaaggaaatgattatgagctgtttgttggacagtaaagggaagtgataatgataattttaatatagttaacattagcttgaaacacatgaaactgatatttttgtgtgtaaacacctaagtgaatattgacaatttcacatggtttaatttaatattgatcaaatgctacgtggtaggcactgtgctaagtaatgtatagtccattaatttgtttaaatttcatccaaaaagctttgtaatagatgaggaaattaacaataagttagggaacttgcccaacatacaaagaggacatagaaggtaaacagtttaacatcagagtcccttttcttaaacagaatactatcctgccagggaaaatatggatgtcataaattatgttatcaaaatcttgccttccaatcacttatttatgtcaacaaaaatgtgacaataagatataccatggttaattcacagtgcgaagtgtctgcttctagaaaggtgaaatttgcttataatacagttattattataccactgcaatatcgaggtcaagttctatggctacaaaatgacataatctttactcaagaaggtcacattgcagtaaagaggacataattataaagagtattacatcactagagttagatttttttttgttggtcaaatgactcaatccaaaaagtaggatacatagtaagaatgtgctatagagacaaagagataaatatctgaaaccaaggccccagaaaattaacaatctatgtcaaccataactgtattatccatgtgagtcaatttctatgggaaatacagttctgttatctatggataatacagttcttcctagaggaagaagcaattaattgatcttggaggggtcagggagagtttcatagaagatataacaactttacaaggcttgagggatgagtgggattgcattaggcagagaaaagaagaaagacatcctagaaaagggcgcaacatgtacaaacagaggaatgtgtgacagtaaacagtcacgttgaggaacagtaaatggtttatgtggctaggaggcaagtttgataccacattatattctgtattcctaaaacacccagacacgcgaaatgctgaaacagtaacttggactcttttgtgaagatcccaggactggaaatttctactgtgtcctagaaagcaatgataagccaacgatgctgtttccttctcgagctataactttcatagagggaagtgcacacatcttaaatggacagcttaggcattgttacatattagtatacccatgaaattatcacccagatcccttgcttggaagaccaaatgtcttttttcccccctcagaaatttattaccatttttcagaattaatattttctaaaacccaatataaaacattatatataaccattatggactgaactgtgtcctctgaaaaactcatctattaagccctaactcccaacatgattgtatttggagacagggtcattaaggaaattatttaggtaaaatgaggccacaagaatggggccttaatgcgatgggggtggtgcccttataagtagaggaagaaacacaggagaggttcctttctccactttagttcatggaaaggccatatgaggacacggtgggaaggtggccctccacaagccaaggagagaggcatcaccagaaaccaactctaccaacatgttgatcttggacttcaagctttcaaaactaccagaatataaatgtcgtctaagccacccgatccatggtgtctcaatacggcagcctgagcagactaatccaacagtctcgaagaattaaatttagaattggtcatcaagattttgttcacctcaaggaaataaaatgactcaatcctccacggatttgtttccatcattttcctttcctattttcagattatttgcaacctggagactgccctgcaaaagcacgtggcaatttccccttctggatcctcacaggagaaaaataaattcacattaacaaatattcagatgctttatttattctgaaaaaaataaaaaagtgaaattgctaaattgctaaattgagtttttcactggtcaaaatttacatagcccaataggtgtaggctccttactccttttgaggcattttctctctcttgattaacagtgatggatttttattgccccacttctgagaggaggatttatatgtcttttaatctgtgtaagttggactgaatcataaatggttcaccctctaaattacagagtaagtttgccaatagagatgaccttgtttattaaaatctaattaactgaagttttagaatgtccctgagtgggttgctgaatttctgattttctccaaaccaatatagatcaaatatccagctggctggagttaaccacaaagctctgaacctcactgtgaaattatctagttaattcctctttcagacattttttccaaaggtacaagcccaagaatcctttaatatgttggccatcctatttcagaaaagccatgtgcccaattatgagttggagaaagaagcccaggtgctccttgttcactgcaactgaaatgagaggaccctggagtgtaactttcattccccagcaatggtcagtcagaatgtctctgatcatgtgccacttttcatcttctggacaaagttctatgctgcctatacacataaggcagtaatattcatgactttttactgccaaccttggaaagcaatgttggcaaattgattacagacatatgggataaaacataattaattgattcagttcctagtctatatacaaaattgcttaatgctaaaactcctctagtttctgccctattgcttcttccatttctcattccaactttaagagtttaaggtttgtctcttctctctcatctcccatttaattatcagctattgaactttttcttcatgacattactagatccctttgtgtcccgtccaccgatgatctccatattgatatagctgatgtacatgctttaattttttgataacggacatttttgcaatatttaacataatataccacctcactcccaccccaccctccagaagctctctgttcccttggcttatagtacatataattcttttggttccttcagaattttagatcctgtattttcaacttctttggttcattcttcttctttcatgctgacactgacagtgctctcaaggctctttccatggctgcattctgacttgcatttagtcccagtcactgagagatattttgaagttctgtttttatttgggccacctcaccctgaagagtaagtacttttcattgttgtagctgaggtggtgtgcctttttcaaacgtctacgtcccacagcatcttcgagatattgataacataaaaacaaatatcgatcatcctaagggccttacagacttcagagatgggtaaaagaaaccacttccaccttcaaatcagtcttttgtatccactaggggagcaaaatgacctgctgagttgaagtgggaataacaaagtatctcaaagatgatgtgatgtttgtagagaaaagtttgtggcagtaatcgatacaggaatcacttatatggatctgtgttacttggagggggctttagaaatggcatcaagaagaaaaaaagcaatgcttcttggtttaaaaaataatgcttttatcattgaaaaatagtaccttttaagatggccaaatccccaaaataaaaattcaaagcatattgtacttccttctgaggccaaatgcatcagaactaatgctcttttgagaaaaccatgctatttaagcaaaaatttagggagtggagagtccgattattgtttttcatgagtgttgaagtctatggaaacaatgaaggaatgtacagaaagtaaattagataaagatttgatttataaaaattgtccaggtttagaaatttttatatatccaaacagaagtcatgaattaggtttccccaggctgtgaactagactaaggtggcatgtaccctcacattccaaagctgagtgccctctctgtccgtgtcacccagttaccctccttgggtgacataagagaagcccaacaattcctgggggtgtctcagagtccagcaggaaagatttatttgcagagttgagatgtcagcatattccgtctgcccacaaccatcatcaccatcatgggagtggactatcgctgtttagtttcaagggaaagaaacatggatgtgtggaatgaagccagccatgagcaacctttaaaggcacccacccaggggccatcaaggcaagagtgaggaggagtgtgaactgtgcagaaacagaggggagttgtcagtggctgggtgcacatggcattccagtttctgcacttatttattggttataaataacgcttcagaaacaccgagaagtcctagactattcactctaattttaaaagaatactgggccattataagggaagattttccccttgactacttttgagatgccaggagttggccattaattgctagatatgaaaacacatggaaatggcaaagaggctacacatcaagcattccctctactaatcatgcaaatgagtcatgatgtacaaaatgtaaggaactcctgtttagggaaaatatgaatgtagatgcacaaagtaaaatgtatgtagtccaaattagtcttctagccagtaaggcaattttcctatatgataaaaagaatggatttttatatcatttaaaggaaatacattgaaattattttagaatttaaaaaatgtaaacatgcatctttccttcttaaactctagagtatcggagatttgatctgtttttttctagctcagctattaactggttgaataccttagtctaggcattgttttattcctagtctattacctctgaaaaatgagggtagtaattagattatctcccaaaatattactgttctaattgcatgtggggaaattgcgtagaactacaaagtcttgtcatacaacctacattaactggttgagtaccttagtctagacactgttttattcctagtctattacctctgaaaaatgagggtaataattagattatctcccagaaatttactgttctaattgcatgtggggagactgtgtaggactacaaagtcttgtcctcaaagggctcacactgcatatctacgtgaagaaatattggcccagataaactaaccaacttacttttacatagagacagagccaaggtagggtttgcctttgcaaatctaagtcttgtacccctttcaccacgttaatgagatatggatcttctaattaaatattaatttctaaagaaataataagccccaattacagaaaaaaaaagatactaaaaatatttcaagagcattcaaggagcttcaatacaagaaaggcttgttgttgggtttttttcatctctctccattgatagttaagtacatacgggtagctattttagagctgcgcctagttaacgtctatgtttattcatgtatttattcaatcatgaaacacgtggagccggccacttttatttgaatccactttaaataaacacttttgtgttgattgtacaaagttccatgaaacaatatatctgccctcagggaacttgctttccagaaaggcaaatcaaagaaaaacgttttgcaaagaatcccgaaatggttacaagggctttctaagagaagtctaaattgaacagataattgtctcacattttgtaaaaggcctagactattctcactgaaaagcagtaattgaatctgtaattactttcatttcactggggacataggcatggattctaaagatctcattgtcatggttgttttcttaatcactctcattgcttcctagcaacactagcttccttccttccatgcaggaaagctcaacagtcaatggtgggcaaggacactatgagaaacatttaatggcacccacccaaggcccatcaaggcaagagtgaggaggggtgtgaacagagggacctgccgcttatttgcctttctgatgatccagcccctgtttgttttatgaacaaaggctttaacttctgacatagaagcgatttttgaaaatgaacgtaaaggaactggcaaactcagcccatgggtttcccttttaagaacatgaaatcacctcctcataatcatttcagtgatgccaggaacgttcctctctctctcccattcaccctccaccattcacagagatttgatttctagaattttgtcaaaagacaaaattgcacaaaaaattaaagatctaattggcttttattagcaattctcaaattgggcaacaccccactctataaactggaatagctgtcccagtgccctgagtagaggagattggctttataggcagaaaaggtctgaagaaagcagaaacaaggaataaaaagtggattggtcatttcaaagttactttccttgtagggttaaaacagggggatctcttatcatgccagctcaggcaaactggtctccttctctctttttggttttgacaaaatgtcttgctctatatggtggtatgatctcagctcactgaagcctcgacttcctaggctcaagcaatcctcccacctcagcctcttgagtagctgggacgacaggcatgtgccaccatgcccagctaatttttagtatttttggtagagacagggtttcgccatattgcccaggctggtcttgaactcctgagctcaagtgatcctcccatcttgatctcccaaagtgctgggattaagggatgagcccccacgcccagccaaactgggccccttctgattgatgactatgactctcctgttatttggaaaactggtggctttcaaagttcacgttagttatgtggcacctagcacaagtgattgcatgttggtttggtctgagttgttgggacctactgcagggcctactccaaaacaatggcctcccataaaccctgtatgacagtctcattaaggcattgcttctacttaactggtttgttaagtgggaggtttaaggtttgtcacctttttctctgagagcaggttttagtagagacttggacagagggcatgtagcagagaggatacagaaagatggagctgagaacaaaataaatacaataaactaaaaattcgccatacttttaaaaatatttaacaaaaactaactttggcttgagttataggtttcctctcctgttttatgtgcattagatacacacttttaacaattagatagtttttggtattaaccatgaagtagcatcttatttctgggtaaagtctgtctatttttttaagttgttttaaacttttaaaacattttttagttatgaatttattttattttattttattttatttattttattttatttttgagacagggttctgtcacccaggctggagtgcggtggtgtaaccttggcttgctgcagcctcaacctcctgggctcaagcaatcctcccacctcagcctcccaagtagctgggagtattgatgtacaccaccatgcctggctaattttaaaattttttatagagacagggtctcaccattttgcccaagatagtcttgaattcccacctcagcctcccaaagtgctgggattacaagcatgagacaccatgcctggatgtgaatttttatttaagagatagaaagaataagaacaacccaaagattatttaatagaaataactagacattaatcaaaaatctttagtgtaagccattagtaaaataactttccaggaaaattcttataggtttttaccttttgacctactttttctaaacacttgctatggaaaaagtacagtgtatttgaggatgattgttaggaggcagaaaaggtggagaaaagagaggctgggctcagtggctcatgcctataatcccagcactttgggaggtcaaggtgcgcagatcacttaagtcaggagttcaagatcaacctggccaacatggtgaaaccccatttaaaaacaaaaaaagatggagaaaagagatacaaagatttagaggtaaagtgaacttaattgtctgaacaagaaatcaaacaaaagactccaaaaagtttagaagccatccttgagatgcagatttaatgctaaaaatgttggcattttcagaatattacaatgatgaatgttgacagtcaaacagaattttattgttaagcttgtcctggaaaaaccaagaatgtttgattgtctgtgattgagacacagtccctaaatctagtttggaaaagtgacagatgtttcaggttgggatacaaaagacaaattctaaataaggaatgaaggagagaaggaaacatggaggaaattggtgggacattctgtgccatttaaatatcttgactcttgttaatgaatgtctatatagaggtcaaaggtgaggaaaacagacaaatcatgggtatctaagaaaggtgtgttttctatccaggaagaaaggtcaatggaatacataaatatagtgatataaactttaaaggtaggaaaagcccttaaaaacagagtcagtaaagattttgtagtccctggttcatagtcacaaagtagaagacaccaaagccaggaaatacaccactttgtagttcattaccctgctacttctagtgagatgtgtgcaaaacacttgtcagaccttattgccaattggcatttgagactatctacagttcttttttttaataacctcattgaagtataatttaaataccataatattcatcgattttaactgtacattaactgtacaagtgtacaggtttttttagtaaatttttagaaaattcattgagttgtgcaacaaatcaacacaatcccaacttaggacatcaacattatccctatacgattcccggttaccatgaatttctgtttctactcccagcccgacaaccactaatctcctttctgtcctggtagatttcctttttcatatcagtaaaattagaatatgtgatttttttgtgtgtctggcttctttcacttagcataaggtttttgaggtttgttcatgttgcaacatgtattcagatttcattcctctttattgtctaataatatttcattgtatgtattaccatacttttatccattcactagttgatgggcacttgcgtgatttccactttgggcctcttatgactaaatctgctataaacatctacctaaaaggctttgtgtgaacatatgctttcatgtctcttgtatagatatccagaagtagaattcttgagtcatatggtgtgtctatgtttaactttttaagaaactgccaaactgttttcaaaaatgactgggcacagtgtcactttagtgtaatccaagctacttgggagctgagacaggagaatcatgactttacagcccaccccccgagcaatgtgtgatgattccagtttctccaaatccttgtcaacacatgttattgcctctccttttgattatagctatcttggtagtgtgaagtagcatctcaatgtagttttagttacatttgcctaaggaatgatagtattaggcttcttctcatgtgtttatgttgtatttgtacttatatctatgagatatcttctgtagctataactttgacttcctgaattctgtccagaaatttctagtttgggtgatgctgtgatggaaatgcatgaaagtatgcagagtaaacattttttaagggttactaaataatcctgaaacttcacaaaagagaagtccatctactctgctagaattactgtataggaaaactcagtgtaatcattttcataatatttggtagaagagcaggcttattgtaaaaactggggatgtttatttttctttagggcttcatttttctactttttcattaagctaaggataagattaaactgcctggaggcttctttgctttctcagcacaataaaaaagtcaaggaaagacagcaaagcaagacagaattcttcagaaaaacaatactgaagggaaataacagtaacaccaggttagagaaacaaaatccatagaatcaagctttacttgagtaacaatgctgatggaaatagcatgtaagagtcttagttcagggcctattggaaatggatgatagaatttttccaatgtacaagcccactaacagatataattagcttattatgctaacatgataaatagttactgaatatctccctaaattagattgacctcaatctgtaaggatcgtaactttcaacaaaggctcgttttgcttgcaaaaagattcacacaagatgctcagatggacaacataaaggtatttcagaggacccctctccagaaaccaaattggttgtggaggctaggcacagtggttcacaccgtgaagccaggagtttgggaccactctgggcacaaaagcaaaagcaagacctgtctctacaaaaaaaacatttaaaacagtgggcgtggtggcatgcacctgtactcccaactactcaggaggctgaggcaggaggatcacttgaatccaggttgagcctacagtgagctatgattgcaccactgcactctggcctgggcaacagagcaagaccctgtctctaaaattaaaaaaaaaaaaaaaaaaaaagtaggttgtgctgtaggatcacaaaaactttgtgctggttaaaccactttactgcctttcatgaattagtttccacaactaatgtagagtccgcttctttgagagtttcacatgccattgcttgtggctttccattctctggatccctgtttagatctttggtcaaaagtgaccaaggaggcatctttatactattttctccttttattattttctcagctgacaattctttccctcttttgttgattgggtaaggaatatctgagtgttattactactagctatacggcaaccttttataaacttcaatatagcattacaaacattggttgatttgggcatgaggtagttctagaattcttttttgcttagtatggtatattgatagattaggggtaaatgtgaataaaacattgcagatatctttgaatttatgacttacaagtaacctcaatatttcagcctagctaaagacatctttaaaaggtaattttcacctcatctataaatgagagttaaaaggaaaattcttttaatttacatagtggtgttttggcttatattctgttttggtttttcccctttttaagacgaaaagtccaaggaggggatccagatagtgtgaatctgaatccagactgccactggtaaactttgtctagctaaattctctgattctcattcttctcatcagtaaaatgagaataatgtacattatctcacttaatgattattattctcacttaatgaatcatgatattaaattttcagtatcattgaccaataatgcaaacattttcataaaacgtggcttataaatttctatcatccctgatgttaatcagtttttcttgcaaaataattaagtaatgcctgcttttagtattaaaaatttttttaagttcaaaacctactaaaagtctacatttataaaattattacaaacacttaaaaattatatttccaaattatgagagtgtgtagatatgtgaattcctataaggttatacacatatcaatttgggcaatacaattacataataattggaatatttccaaacacttgttttaaaaatgctttctcctagcactagtttcataagaaggtagtacactgtcactcatcatatataaaccaacattactggctgggtgtagtggctcacacctgtaatcccagcactttgggaggctgaggtgggcagatcccctgaggtcaggagggcagatcatctgaggccagcaccagcctggccaacatggtaaaaccctgtctctactaaaaatacaaaaattagtcaggtgtggtggtgggcacctgtaatcccagctactagggaagctgaggcaggagaattgcttgaacccaggaggtggaggttgcagtgagtcgagatcgtgccattgcactccagcctgggcaacaagagcaaaactccatctcaaaaagaaaataataataataataaaataaaccaacattaccaagtgctgacaatgatcttgagcaacctgaattttcatacatccctggtagaaatgtaaattggtacatgcttttgggaaaactgcttgaaattatccactaaaattaaacatgtgtactttatgacccagcatttctacttttaggtaaatgcttgacataaatgaaggctaataagtaacacatctataagaacattcatagcagctttattcataatagccaaacactggaaacatccaaatgacaatagaatattcattcttattgttgtattatattttatttatataatacaatcttttgtattatataatacaaatacatgcaacatgtattatacaattttttgtattacatataatacaattttttgtattacgtataatacaattttttgtattatgtataatacaattttttgtattacgtataatacaatttttttgtattatgtataatattttttgtattatatatactattttttgtatcatctaaataaatatttaaagttgggtagaaggagctaggcacaaaggaatgcatagtgattccatgcacataaaggtcaagaacaggcaaagctcatctatgatgacagtagacaaatttatggttacttctgatggagtgtactgattgggaagggcatggggggtgcttctagggtgctggagctgttctaaatcattatgtgggtcatggttgtacaggggtgtgtgtgtgtgtgtaaaattcattgaactgtacctttcagattttcatgatcattattcatttcattacagaatgtcatagagattccaccatttaaagaccttgtttttataaaattacccatactatcttatagatgctggaagggttaaacaatgagagtagccacaagtagcagagcaccttctcttcctacaggatagatctcacttgtaccaaagctgacatatgactgcctgctatgtaatgcacagtaaatttaaaaatttattattaattaaatttatttctcactgttacaataaataaattgaagtgtagatggtttctgtcctcttgcatgtttctttgcatttattctcagtacatatttttgccccctctttggtcccttcccaaaccccttgctcaactttggaaacttgattgagttacacaacagttgcctaccatgatagtcagtgggatatttgctcaataaatttctaaagcaaaaatggacaattatgccccattatgagttagaattggcaaactctataaaggaccacataatatacattttagactttgggggggtcttatgtctctgccatagcttcttacctctgtagttgcatcatacatagacaatacatttttttaaatggctgtatttcaataaaacttttttatgaacactgaattttatagcatcacaaaatattttttcatcttttttaaaaccatttaaattgtgaaaattattcttagctagcttttgagccatacaaaaagaagtgatgggcagaatttgggtctcaggacttagtttgcagagctctgatttagagtcatgtaattttaagtaataacttgaatctcaaccttcagttccatcatttctagtaggttatcaaattaccatatgctgttagagagtgcttttatttattgttcctttaagaagcactaaatattaagtttaatatcaaaggctttgtttcctctttggcatgattgtaattcataagacttctaataaaagagggtgggtttgtaaaaaattccacagatatttgaggcctagtcattagtagctacagtgtcaataagaatcacagtacttttctgcattatcttaattctgatttgataaataattattttttaaaaacccttcattttgaaaacaatgaaataactaaggcagtatataatgcatttatttgaggccaactggccaagttctgtgactccttcctgggtttctatgggtcctgacacatgaggaaacaaatattcactgacattcaagaaggtcagaggtacaagtaactgctccacactgcatagcattttcaagacaggcctccaagttggttcctctccattccctgcactatttgctaagagacatgaatgataaatctttacatcattgaactgtctgtctcattctcctgtcatccaaaaatcagggtgggatttttctgatgagttctatgtgcaatttcaaaattgttatttctattcagactgaatagtaaaaaatcatctgaaagggtaaatttgaggaatgacatcacactgctttgtgcctcccacccattcactcccaaatgagggatccctcagccacagcagcagaaaaagaggacaaaaggccactgattttccatgaaggtgaaatctgtgctgcacgggctccaaaactcactgcacataactcatcttaagcccatctccaggaacccctcctgggtttctatgctccattctagagtcagtactttgcaactagccttgtctttcctcctttaggatggatacagggtagacttgggagacctgaaacaagataaatatagagtcaacagaagaacaaactcaggaggaaagccaactgggctcaaatctcggctccactcttcattgtagatggaaatagacacttattgaatacctgttctgtgctggaaacttcacataaactgttccagttgttaaactaaacaagaagagaggaaggaacaaaaggtgtcccttatttaactcatgtacaatagggaagaaaacttctgaaggaactgcttcaaatagggttttgtttcacatattattcaagcgaccaggttgactttgttgaacttctgattccatgacaacagcaaactctgcatgtgtgctcagggtttgacatgctgtggtgtactctctacctaaaagagtacgcagcataatggttgtgaatctctggaaatcagggtgtcgcttctgttttccagaagatgaagatgccagaagggcttctgagcaatgtgctatgagaccacctatggaagagagagaacaactctttaactgtggctttacttagtaaacttccaaacgattactgaaatgtcatcattagacaacgtaagcaactagcagaaaattcatatgtctaatgcagcctcctcattctttttctgtctttccctgtgatccaggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcctctatattcatatgtaacaagtttgactacctaagtttatgatgatattaatagcaatgctaatagcataaatgcagtactcaacagctgtgattccacggagtgctgctgttaatgccattaggatgactatttatatcaccataaaccgagtttatggtgatataaatagtagcattatggcttaatgtatcattgtaaacttggattatggccatataaagtttgacattattgctatcaaacttcatcatcatcagagcttgatggtcccttgtaagccaaagattgtttctgttaactatgtcttgctttcaagattagtcaccccagagaggaatttggggctgctagcttggacagtgggaggtaagggagttggagtgatggtccctcctaattaagggcaccattaggattttatgttgtttgatacccttcggtgtgctttatgtgcagtcagagggaaacagtgacatggttgcactgtggggattctgcagcgagcatcctgggcatcgttttctctcttctttctgggacacgtggtttaggcaactctcctgagagttctatgcttttgtgattgtgtgctaggcatccggagacctagattctgctccccaaatagctgacttgccaggagacctcaggcaaacccctccattgtcttagctgtggtaatgagaataccacacacatcccaattcctcctggggaggctgtgaatattttagtgcctggatttggattcctcctagcaaagcattatgtgagatggaatattattaccactttgtaaatcaagggagaattagacctacttgataataaattatagcgtccactcaaagagatgtcctaaggaacgtaatgatgcatgcttaacagtttcctacttagtaaattgaggttgtcagcaattaagcaatgccatgttcctaatacaaaagggagatggactttgtactgatttttctctacttacattgaaaatgctacctgtaaaattgagactggtcaagatctttatcacgcacttattgaacaataatacttcatttgtttagtcaggcttagtaaaactgtgcagaagaaatttaatttcaactgcctaagaaaaggatattcacctaaagcaatagtatatatgcattttaaacaaatattataagaaatgaaatacagtgttgctctaaaattaggaagactgtcatgtgttgtctaatgaaaatcatttttgttatggaataattactcattagcatataaaggtaaaatatttctggcttaccgattctaattctgaagttagctttgaatttgagaaagtgttcccattaaataattgattaacttaatatatttataaaaattccacttctgcaaactttttttcttgtctgttttgttttgctttattttctttttttgagacggagtcttgctctgtcgcccaggctggagtacagcggtacgatctcagctcactgcaacctccgcctcccaggttcaagtgattctccagcctcagcctcccaagtagctgggattacaagcacacgccaccatgcccgactgatttttgcacttttagtagagacggggtttcaccatgttggacagactggtctcgaactcctgaccccgggtgatccacacgcctcggcctcccaaagtgctgggattacaggtgtgagccactgtgcccagccttctgcaaacttttattaccattcttaaaaaaaagattctaggaacattaaatagtagatgctgcagtatatgagcactttataattaatattagcttatttgttcttaataaatcagcctcaggaagaatttattgtgaggctgtcattcatctagaactttcctaggtgctctggaaagtaagaaaaagaagttcaaaccatgttatgtgaaatgaacatgaaaaaatattggaaaacacaaattggcttataatttaattttaggctttgtaatataaaattattgcaactgataatcaagaaaggagccatagaaggtgtatttcaggcagactttctttttaaaaaagagaaaatgagaaaagtatagtggtcattgttcatttgcatttctattctagggctgttgttcttagaaacatttttagaacctattatcaaaataaacttatttattcacattacatgatctcagtatacttataattactgtaacttcagagaaactcttttaaataatattttacctgatatttcatgaaagcaaaagcagtcaacagttaatggcaattatgtagaatacttttgtgtctgtgtgagagagagaaatctcattgttttccaggcaaccgagaataagtatcctacctggtactcgaattgcctggtagcagtcagcagttgtgaagcccatgttccctttaagaatgttctcacggccgggcgcggtggctcacacctgtaatcccagcactttgggaggccgaggcgggcggatcacgaggtcaggagatcgagaccatcctggctaacgcggtgaaaccccgtctctactaaaaatacaaaaaaaaaaaaattagccgggcgtggtggcgggcacctgtagtcccagctactcgggaggctgaggcaggagaatggtgtgaacctgggaggcggagcttgcagtgagcagagattgtgccactgcactccggcctgggtgacagagcaagactccatcttaacaaaaaaaaaaaaaaaaaaaaaaagaatgttctcacatggacacagtagtgatagagtgttccgtatcaactgcattttccagtttttatacatatgtgatctccctggttacacacagcctcctgtgaattgggcagggcaaatattagtctttctgccttacaaatgaagaaaatacttctttgaaaatggcatttacacagcaaatttctgagcatactttcagcctctgagaggcttcaggacaaaagatggaacagagaatagaaatagctgtgtctgtacaaggtcagagttgttttcccaactgtactctcatccctgagccaattgttgattaaattaaaatgccttaaaatgtttcatttgggttttatcccaccactagcctcagccacacatgtcagttaccaacatagtacaaacattatagggattacatttatgtaatttaaaaagtggcatagtgcatttttcctgctgtttatagagatgaacttactttgtgtcatttactgaagtctgttcaaacctacagcttataaagactaaacctattgttgaaaaatatctttcagtttgaggagttgagtgatgacagccctcagaacctgcctcttgaattaggccccagttccatcctctagtctcagagaatgaaaccatttttgtgggctctgcccaaccatttcagcagttttggttgatttcatcatgcctgctgagtttcatttttgctttgattcgtctgaactcagacccatataatcaaaatgctaaagaaaatcagtgcatgccactcagatctgctgcatttcccatatagttctgtgaaatgcttatgtccttacaggtgtgtgtgtgtgtgtgtgtgtgtgtgtgtggttttttttttctttcattctttcttttttgcaaagcctatccaaatggaaacttcaaatcaaatgacactgaaagtatgagtggtgacggatggttcgctgaaataaaaagtgctgtgaaaatacaaatccccctcttaaactacacgtacgcacctagaaagaaacaaaagaaccatttggaagattaaaaatcaatgatcaggtagacattgtttcaaattgaaatatgtaatcatctttgcagatggctgccaaactttcatactttcatgaaattagttaaaaaaataaaagacttccactttttggaggtagaaatctcatactatatatgacgaatataattaattgtaggaatatagtatttgctagacaattgctttattttcagccatatgatgtaaaactttactgtactcctctagggatacggggactgtaaataaatactttggagcaagtttgtcagaaccataggaaaggtttaaaaaaaaatcaaatgttttcagtaaacctgggtagaaacaattccagaaaatgtcttattcaagggcttcttccaaggccatgccagaaacactggctgtgaagctggcagacagagcactggagtcacactgcaggattaagatgcaaattcagtttctcagagctacggaggtgacccagagagacaaggaaggaaaggcaaggcagtagtgacacatctagttctggaacactcagaggacagacaaagctgtgtgtaaacaaataaagatactgatggagattcatcaagatgatggtgaatatttgttctttgggaaagttattttatgtgccagactaataggaaggccattatcttttttttgcaagaattttacaaaccaggatcataacctgccattcccttgacaggagagataagatggccaggcatggtggctcacacctgtaatcccagcactttgggaagccgaggcaggcagatcacttgaggtcaggagttcgaggacagcctggccaacatggtgaagccctgtctctaataaaaacacaaaaattagcagggtgtgctggtggccgcctgtaatcccagctactcaggaggctgaggcaggagaatcatttgaatccgggaggtggaagttgcagtgagccaacatcgtgctgttgcacttcagcttgggtgacagtgtgagactccacctcaaaaaaaaaaaaaaaaaaagcaaaaacagacaaggcaataaggcaatgcctcggtctccacgttgtttctgtaccaatgaaacatttccaacaggggcgcacatggcagtaactctctttcagaagataatacccacgagcatacataggccacatactctgtgcagtgaatagggactgaaggagaaaccacttctcatctgggttcaggaagcaattctccttattgagaggaagcagctctccaggctccagagaagagttcaaaatttatttatctcctttttctttgctgcttcaggcttggaaaaggcaagaaaggaaaagggactagcatgcaggttctaaaccaatcactttcgattcattttctctcttgattctctcaacatcccttaataggtgatactgttgacaaaaaaaaaataaaaataaaaataaataaataaaaaagtaccctgtaaaatatttaaagaggtttatttaagccaaagatgagtggccatggcccaaggtacaggctcaagaggtcctcagaacatgtgtccaagggctacaatttggtttttatatgttttagaaagacataagacatcaatcaatatatgtgaggtatacattggtttagtctagaagcaatgtgagagtgtggcttacaagtcataggtggatttaaaaatgttctggttggagattggttaaaagagttaagttattatctgaaggtctggaattgatagaaaggagcatctgggttaagataaggggttgtggaggtcaaggtacttattatgtagatgaagtctcctaggtggctgcccttagagacaatagatggcaaatgtttccatttagacctttaaaaggtgcttagactctcagtaaatttcttctggattttgagggcctggaaggggaaagatctagttatgttgatagagattattcatagatgtgaattttcccccacaaaaaaactgcttagcagggtcatttcaaaatatggcaaagaaacatgtttgggtgtgaaatctttttatttcttcctttttctgtcatgtgatgttatgctagagtcaggttaaaatttggtatcttattgctacagtctgtaaactgtcatggccctggtggaagtatggcagtgaggacaaccagaggtcactcttgtcgccatcttggttgtggtgggttttagccggcttctttactgcaacctgttttatcagcaaggtctttgtaacctgtatcttgtgccaacttcctatctaatcctgtgacttagaacttctaaccacctgggaatgaagtccagcaggtcttagccttatttcgagatggagttggtgcttagatttttagttttggttcacagtacctttgactccagtgtactgatgaggaaacagaaacaatgttattaggtgctttgccaataagtttcagagttcagactggaatctacctagttccaaagtcctcctttctactctattcaatcagagctgatgttaggataaaaatgggaagaaaaaaaaatctcttatgctctcggggagtggctgggtctagctgtttgctaatgagggggtctagggaaacatccctattgccctgtgaagggtcactgaaaaaccaactcacaaggcaggttaatagaagaaaaggcatgcaaattttactacagggagaatcacagaatgatttctcaccccccaaaggagttcagaagcttatatatcatcctggaaaaacaggttttgggagcaggggaggagaggaacttcactttcactgtcaaaaggactatttactggctgggcgcagtggttcatgcctgtaatcccaacactttgggaggctgaggcggatggatcacttgaggtcaggagtttgagaccagcctggccaacatggtgaaaccccatctctactaaaaacacaaaaatcagctgcgcatgttggtgcgcacctgtaatcccagctgctcaggagactgaggcatgagaatcgcttgaacccaggaggcagaggttgcagtgagccgaaatcacgccattgtactccagcctgggtgacagagcaagactctgtcaaaaaataaataaataaataaataaataaataaataactatttacaagttcatctctgttcctagatccatttattctctctggtaatcccctcaacagaattcctcttctctccactcccataatctatttttccaggatggtaaataagcttctgaacccccactgggggtggggggtggggagtggtaatccctctggggctctccttggttctccacatgtacatgttaaatcaatatgtatgccttttctccatttaatctgactcttgggagttgatttatgtttttactttttttttttttttttttgcgaatcttcagagggcaaaggggaagattccattggctcttacactggcaagctgtgtcttctaacttactcttacatgaagggctggttctgaaagcagagataaaaaaaggataggtgacaaaaactgctcccagtcccatgcttagtggagaaaagatcccccttgattttgcacccctctttttgacaagtcatcaaacaactgatctttttccacttactgcatctattttggctcccctaacagtgtacttcttaaaagtaaaaacaaaatctaattcacttgtatattctcagtagtatcacatgcctaacacctagaaaggattcaacaaatgtttgttgaatgaggaagaaaaataatacatcagagcagagggagagtgataatgccaggtttggcctgaaactcagcttctgcccttagggcactcatcaccccaagcagagaaatctcagggcgctggggctttggagttctctaatggagccacaggtgctgggccaactgacttcctacatgaaatctggattttagaccctgttttcctagacccctcatttcctgcttgggtacagctcttgcctctgccttttcttttttaaagttttcattacactgtgtactgatttctggctcactttgcttccctactattgttctgaaagcttatctctgattcagccccacccagaaaagagaggttgcctcaggcaatctatgtaggatgataataggtgtattaccagcatagaggaccactttctctctgtctctccattcctgccctggccattaattataatacattcgatttacttgggtttggtcttcagccctcatgcttttgcaacatcatgatgggctcatacatgatttttaaaaagagcattaacatcacaaatctcagaatgggtaacgtttgatcattcccagtaactatttcctgagaagatgctctaaattgtttttctttccccattttttcccacaaaatgtggctgtatatttttgcctcacgtatagctcaaaacaagaccaagaatcacagtgtcctaacagtggaagcgtcttagagatcaaccagtgcagaacctctcattttacagatcaggggtctgggtctagagaggttaagtgactggcccaaggtctcagagctggtatacagcagagcacatcgagaaacagtttaatacagccttcatccttagtaattccccagggccaagatgaatgttgacacccaaagaggaaactttgacctggaacaatgaccttgggtctctgcctatcaacagctgagtgggtatcagaactcttaatcttactccatcatgagatcaatcatctggaaatcttgatagaaaacctacagccacagaagtgagggtcagtggcagaaagttgatgacttctgtttttttgttatgttttttgtttgtgtgtgtgtgtgtgtgtgtgtgtgtggttggttttttttaactttttagggttgataatagaaggcatgaaaaaaaaaacaaaagcaaaaacgccctggagtgatgtgtagaaatcattaagctctattttttcttaatgtcccagccttcactgctattgccatgggctactaacaactgagaagcagtagtgggtctaagaacaagcagaaatagtgaaattttcaggatcacaacctaggctgactcccattaatggattgagcccaccgggcatttctgaggtcaggtccaattacaaatgctgtagcttttacaagtagatggaagccttcccttttatcttccagattccagagtgactttaaacaattagaagaaatggacaattcctgcgaaggaaatcagctctttaagattactcagttactcaacttcagctgcaaactcactgttgaaatgggacgtaaaattggttacagtttggaaaaaagtctttctgttttacaattgacatgatatttgtgtgcgtgtgactgattttcttacctgtcctttcaaataccatttgtatttggaggaatcgtcacatgccacagaggaattaacgtgaatgagctgatgccagacttggttctgcaggtctgtgttgtcaacaaagagtcaaattctgtaaaatatttgaagacatttattctgagccaaatatgagtgaccatggcccatgacacagccctcaagaagtcctgagaatgtgtgcccaaggtggttgggacacagcttggttttatacattttatctattttatgttattttattttatattttattttttgagacagagtcttgctctgttgcccaggctagagtgcagtggcatgaccttggctcactgcaacctctgcctcccaggttcaagtgattctcctgcctcagcctcccaagtagctgggactacaggtacatgccaccacaccccgctaatttttttatttttagtagagacagggtttcaccatgttggccaggctggcctcgaactcttgaccttagatgatccacccctctcggcctcccaaagtgctgggattacatgcatgagccaccacgcctggcaggttttatacattttagagaggtatgagacatcaatcaaatacatttaagaaatacgttggtttggtccagaaaggcgggacaactcaaagcggagggtggtgggggtaggggttccaggctataggtgaatttaaatattttgtgattgacaatttgttgagtttgtctaaagacctgagactgatagaaatggaatgttcatgttaagataaaagattgtggataccaaagttcttttgaagtcttatagtggatgcccttagagacaatagatgacaaagtttcctattcagatcttaatctctttaggattgggagggtctagaagaaagagatctagctatgttaatagagattctttacagatgcaaaatttcccccacaaagaacagctttggaggcccatttcaaaatatggctaagaaacatgctttggggtaaaatattttgattttcttccttgtctcataatgttatatgagtcaggttggaaaataagtcacaatatataggttaaataaaacccatctgatgaaaatttattatttgtagggcatgactccccacacctcttagataggaatttgggcaagacttaaaaaaaaacaatcagagtttagtcctcagtgtggctggatgggttctgcctcctccatgtcctctctctgggtgcctctcccttcctgaacttgttactctctgcagaagaaacagcatccccagatgcaggcgggagatttctctgcaaattgaatccccgtaatttggtttctctgctgaactctctgaccaatctctcaccatttgaagagaattagtcttggcctattggatctaaacatccacagtgtggagcatactttggaagtgacagaaacacggagtgaaatagagtctaacctattccaggatcagctcctgaaaacaaattcaacctaagagactttattgagaaaaacgagacatggctctgatcctggatcagtttatgtttcagtgagggtgaaaattttaacaaagtggaggagattaggatggaagtttggattcctagtgggactttgagtggaaagctgagaggcctcatgtagttgtgctttacaaacattaatgtacttagaaaccacctgagatcttgttaaaatgcagattctgattcaggaagtctggagcaggacctgagatgctacaaggtgtggctgctgctagccaacaggccacgcttaggccagcaaccttacatagcagcatggtgaacagcacagactttggaatcacacccacctgggtccaaatcccaactttctccctcactaaccatgtgcctttggacaagttccttaacctctctgggcttctacttctcacccagatccttacctcagctgcaaatgagaataattgtaacatcactgagtttgctccagtaaagcctgattgtccccagtccttgcacatagtcagagctctctaagtgttagccaacatcatcattcttatatccatttgctgtggaaaaagtggcaggcttgatatcagaaaagctctgcccatcttcctgctccatgttcctgtccctgtacccttgacttcatgccttttcttggagaagacaggcctagtctcaggtgacagtgtagcatccagccatttagcttctcctaatttggaggtgctggccacaatacctgattagagctcaactgcattttctgagtccccagggacaatgtccttccacataagcaatctctcatttccttctcatcatgtggatctcagcttcgatgttaattcttctaagaggacttctttgtccactcagctgacatagccactcacacctccctacagcccttcttaattttcttcatagaatgtgccactccctggaattatctctgcaatgcacaactcaattctgacaccaactgccctgagttagcacagccttcacaagttaaaagcacagtccccaacaaaacagccttctcttcacacaccagctgcaaacttgggtggctctcaagccactcacatttctgaccaactgactacaaatttggggttgctactattctttcagggtcaataattcactagaatgactcacagaactcaggtaagtgctatacttataatcagagttttgttataaaggatacaaatcaagtctagccaaatgaagagatgcacagggtgaggtcgggggaagcttcagagacaagagcttgcatgtcctctccctgtgaagtgagaattgtaggagttaaagaaagaggaaagaaacacaaaaggcagctcaacagtcaaagacaggtttattttggagaacaaacctaagaggggcttctggctgatttcagtcaagagcactctctcttacagactaagagtatttaagggttttagggtgagagagcttatcacaggcttggactgtttctgtgtggaagagaagtttattgcagggttgaaatgtctctggttggaggggggttatcttggggctgacatctctccggcctctctggccagaggggagattatcttggggctggcatgtctctggctggggaggggtttatcttggggttggaatgtttctgattggagatatcatttgtggtttatggtcatgctgaccttagcctgatgccctttggacttaggcgatttttttatcaaggggaactttaaaatggcggtgcttgtccaagatggtgatgctcctgctctgtcaagaattccctactcttctggtacaccagtgtgcatcaccaaccagtgacgctcacccaggctttgggtgttcaatgatttattgggatctcattctgtaatcatgattgattaaatcattggccacatgattaaatataatgtttagcccccttttcccctcctccctggagatcaggctgatatcaggaagctcaaagcctcaaccctctatcaggtggctggtcttcctggcacacccagcccccatcctgaaaccacctaggggcccaccatgagtcaccttattggcatggacccaggcatggtccctggcgctcactatgaataacaaacactcctatcacttgagaaagtcctagggtttagaaacttggtcccaggaacctgggacaaagaccaaattaatgacctgttatgagtcaatctcttttctctatttatttgctttattgtcaccattgtccctaacagtagacgggaatctcaggcagaagtctgtatcatggtgccaaggacaatgcctgccacattgaggcactcagacatgtgttcattaaattaatatgaatggttaaataaccacaaaagatgatttaaattagcatttccaagtaacaatggaggcagtgcatgaggcacttcatgataaattgcagaaaacttgcacagacaataattgttataaaggtccaagagaagcactatcacttgatttatatgcacaactatttttaacctcaacagggttttgcacatttattcatcttaactaaatgaaaacttttattcctttgtaccttgaaaatcccttgaatctgatgattatctttaaattaaggattaaaaaaaaactcttttgctaagtttttatacattctttggcaattctaaattaagatgcacatgaagtattaaatttatataactcattgtttaatctaaattagattaacccccttggcccttcagagatccaagtagaggcttccatacttttgtttatccatgtctcaaggttattactgacaaaattacaattagtcagtacttcatgtccattgttagggtgctaagctgtgagctataaactacctcactctggcataattaaaaccgtgttccagttcacctattttatgatacctacttggctttccataaagcttcttttcacactcctaactatgtgcaggtctgggaaacttgggaactttactgaagaaaactttaaacataagcttcttcttgaagtttgctgatagttctgttatagcagtcttactatcatcaggataaaaaaattgtactaaactattgtaaaaacataagatttgtattactacctctttttttttttttttttttttttttgagacagagtctcgctctgtcacctaggctggagtgcagtggcgtgatctcggctcactgcaacctccgcctcctgggctcaagcaattctcctgcctcagcctcccaagtagatgggataacaggagcatgccaccacacccagttaatttccacgcccagttaatttttgtatttttagtataggtgaagtttcaccacattggccaggctgatctcaaactcctgaccttaagtgatctgcccacctcggcctctcaaagtgctgggattacaggtgtgagccaccatgcccagcctctattactacctgtaaaataaatcctaattcaaaagtcgccatgtgtatgtacataggaaatagtgcatttgaactggcatttacctactggcataacaaattgctctttggaatagatgcctagtcccaagttaagaagaaaaggggactcctgtgtcccatccatagtttctcattaagtccaagagccaattgtgctaaagtaaatgaatatcttcaagctaacctataaggggtggtgggaatattagttgctagaccaacacttaatcaagaatctctcacactgtctaagggtgaatagaacaactagacttgtagaggattgcttaatctttttatgaaaaagtcatgtgccaattaagattctagccatacctccttcagggttttcttgacttactcaagctttagacaatgaagtggctcaataatcttttctgtaatccctatgtctaatgtattaagtattccttaattcaatttggtagattaccctaatcgattttgttttctggtatttaaacctttagaatttaattatattatactgaataggatacaaagtaggacttgagcttaaaagatggcctttcatttcacagaaaagaaatttatatgtcaagtattttgctgtggtattctcattgacatagctgagatgataatgtaaccagttcacgacgtcaggattgctatgagagaaccccgttactgggtgcttgatttgctcttttggtttatccaaagatactgagtttgctctgactgcctcggttttctccattttaacaaaggcaaaaaccaacactttgtattaaataacctaaaccttggcattgaacttgtcaaaagagaaaatgacctgaacattagagccaagaagatactctgttgtattttactttgttacttaggtatctttatttattctttacttatatatttcaaaaagacatagccttcctttatggaaaaattcatttgttattatttaagtacaacagatagatagatgctccaaaattaagtctgagtgttttctttgcctgcagaactgacagtttgcttggcttatgctgataatccccaaaaaagtcgcttgtgtcttgaacatccataggaaataaaactgtagttccgggcagtgtcgataagaaagcaaactttacaccttcacttaggggttgagaaagagaatgagctattgattccactctgaactttagatggccatatcacatctgaaaccagtcatttcgtggtgggcagtattaaacccgactttgtcttatgactttacaaattagcgaattatgttgttatgataagagaacccaacaaaagtatctgagtttggaacatcaattttcaggatgttatatatttgagaacacttctccactgctcctctaactcctctagcctacctaactttaatagccaggcctccttcctacctgtttccttcccccttcacaagaagcacctattaaggaatcaagaaaaaaaaaaggatgacacttactttcggaataaagtaatatagtctctactatttctgctttcacacagatttgccctcctttctggcacaattacacatacacacacacacacatgcagatatacttacgtatgcacacatgcaggtatgcttagaatttagcattaggctgggtgcattggctcacacctgtaaccccagcactttgggaggccgaggtgggaggattgcttgagccccaggagtttgagaccagcctgggcaacatagcaagaccctgtatttacaaaaaaataaaataattaaccaggtttggtggcacatgcccgtggcccaactacttgggaggctgaggcaggaggatcactggagcccaggaattcaagactgcagtgagctatgattgtgccactgcactacagcttgagtgacaaagtaagacctgtctcaaaaaaaaaaaaaaaggaacttggcatttgcaatcctgaacctactttaacccaaggtaatatggtttggctctgtgtttccacccatatttcatcttttagcttccataattcccatgtgttataggagggacccagtgggagatgattgaatcatggggacaggtctttccagcactgttctcatgatagtgaatggctgtcagaagatctgatggttttaaaaatgggagtttctctccagaagctctctttttgcctgctgctatccatataagatgtgactttctccccttgccttccaccatgattgtgaagcctccccagccatatggaactctaagtccaataaacctctttcttttgtaaattgcccagtcttgggtatgtctttatcagccatatgaaaatggactaacacacaaggtaaccacaactcagggcttaaaacttctggacaccagtgtagttggaagatatagagaggaagctgaagagaaatgagaggcagccttggaactcgttcctctcagataagggggaactgctatagttgtactcatgggtatgactacagcaaaaggatacaaagcaaagtcagcaaaaggaaacgtgcatgagatgaagtccagaggaaaccaaacacaagcttccaagagactcccactggagtccacagaacacacttaattcccccagctattagttgtggcatcatgtgtgaaatgctgtctacaacagaggctcactagagactcagcacccaaggttttattgggtactggtcacaaaggcagcccctaccaggcatgcacccaaaacccagactcccagaagaaaggcagttgtttagcacaaaccacattgtttgtaccaacagttcagcatagtggggcattcttattaatcagttaaccctcctgaaatctaacttggtgggccagccatgggaagcacttctccagcacaaggatgctgcctctctccttcccctgctccccaaacccttctccacactcttttccctctcccttccatagaagtattaagaagatgtgggaacatccagatcttcaacctcacaccaccctgcatcacactcctgacaccatcatactccacttccacctggctttgtcctgcctcttctaattcttttgttgtttttttttttttgagatggaatcttgctctgtcacccaggctgcagtgcagtggtgcaacctcagctcactgcaagctcctgccattctcctgcctcagcatcccaggtagctgggactacaggcgcccgccaccatgcccagctaattttttgtatttttagtagagatagggtttcaccatgttagccaggatggtcacaatctcctgacctcgtgatctgcccacctcggcctcccaaagtgctgggattacaggcatgagccactgtgcccggcctccctgtccgaattcttagagaaggaaaagaaaaaagactgtgctcttttcccttgagctgatcctttgtatctcatggcctgcagtttctgctgcatccattccccgggcagcaccagctacataatttgcaaagtccagtgaaaatgcaaatgcaggaccatttgtattgtgaattttaaaagagagacaataaaccaggtgccaggcccttctgaggctgtgagggtcacacacctatgtttctacgtgctagcgaaagcacaaggtcaaccctagattctgaatatcactggggcatggcagaccttgcagatgtggatctgcaagcttggtttctctaatagctttgaaccacaagaaacatttatgtgatgaaaaccaaactatatatggcaaaaatatttaacacaggggcttcttatatgtactggcaaaccatatcatattattgagttttccctaaacttgattacagaaattacctggggttcttatcaacatgcagattcccacacagctcccctagagattttgatttggattctccagagtggagcccagtaacctgtttttaagaagttttctagaatatttttctgacagggaaagtgtagaaacttaggctcagaatatttgggggcagacaggcctatgctgaaattctccatttatcagcagtgtgacattgggaaagttatttaatttcactaagcttcaatttcctcatctgtaaaatagaaataattgtgctagtacaaaaggttgctatgggaataaaatgagacaaatgtctgtaaagaacttagaacagtgactgctacagtaagctgtcagtaatcgtagttataaatattacagaaaaagagtagaactcatttaaaaccctcagttttgtaatactagatgaattaagcttaaatgcaaattgctaaaggcaacagttatttctgtcaaattaaactcattcagaaataataaattacaatctgaagtgaacaaaaggctcaatcagtcatcaatggtaaacattttgagcactgctatggtctgtttttgtctttccaaaatttatatgttgaaacctaatcacccacatgacaatatcaggaggtggggctctgggaggcaattaggtcatgaggccactcccattaatgggattagtacccttgtaaaagagaccccagagagcttattggccctttctgccatgagagacttcagctggaaggcacgatccataagccaaaaagtagaccttcatcagatatcaaatctgccttaatcttggacttcccagcctccaggactgtaagaaataaatttctgtttttcataagctacccagtttacgatattttgttataggtagcccagacacactaagacaagcaccttgtgttggcagtgtcacgatgcctccgttcttgtcttcttagtttaaaagaatttaaacagctgggtgtggtggctcaggcctgtaatcccagcactttgggaggccgaggcgggtggatgacctgaggttgggagttcaagaccagcctgaccaacatggagaaaccccgtctctatttaaaaaaaatactgaattagctgggcgtggtggcacatgcctgtaatcccagctgcttgggaggctgaggcaggagaatcgcttgaaccgggaggcggaggttgtggtgagccgagatcacgccattgcactccagcctgggcaacaagagcaaaactctgtctcaaaaaaaaaaaaaaaaatttaaacaagagacgcacagtgaagcgggtgcagcataatttattgcaaaagaaaaagaatactttgaaagttaagtgcagaatagacaggatgctctgagagagagaggagtcagggtgggctgccggggaggatgagacagaaaagattggcgggagggagactccccttatgggagtcttacctgattattcctaaggaggtgaaaagaggtgttaccagtaagcatgttctgggtggttctctgggtgcacatgcgcagtagccgcacatgcgtgttcatacgtctcatgtctcattaacatcttaaatctccacctaggggtgtattttataccattataatgaacaaagggtcagtctgaggacggatgaaatcaaagtgcgcatactctctacagggggagtccctaatgaagatagctttgcttgaacgagctcaattaccaagcgaatgctggggcttattgtattgactgtgtggtcaccacggttgctgcgtcctaagaacatggtcatttcttttttcttttttttttttttttttttttttttgagacggagtctcaccctgctgcccaggctggagtgcagtggcacaaactccgctccctgcaacctctgcctcccgggttcaagtgattctcctgcctcagcctctcgagtagctgggattacaggcgcccgccaccacgtctggctaattttttgtatttttagtagagacggggtttcaccgtgttggccaggctggtctcgatctcctgacctggtgatccgcccaccttggcctcccaaagtgctgggattacaggcgagagccacggcgcccggcccatggtcacttttttgactacctatcctgcctcattgatagcaggctgcagatacagaggcgtgaccgatgatttttgcaatcaaggaattgatcatctatttcaggataagttagagaggtgagaagatgcatctctttaaaaggaaacacataaaggttaaagggcaaagcaaagagaatgagtaaagaccattttccgtggggattggtggagtgggtagaaggcttgagctggagaatattagacaatgattagccaaacgtaaagaagcaaaagtttcctgtagaaaaatatgcaaacatacacagtaagcattcagtaaatacttgaatgagaaaatgagacctgagttggaaccagaaaaaccgacaaatgccaataatcccagagctgaagatagtctgtagacagtggggagtttgttagccagaaataggaggggtgagtgggaaatctttaattaaaataaaacctttaatctttaattaaaatattaaactcttcacttgtgcttagttgcagagatctatgcctatgtagttttttaaacaaataaaacaaacattgccaataaaatgatgtaattcaataaagggcttacagtaggttccacatccaacaacgctatactgaaaatacacaattaaaacttattgttatattctcattatagaagtctttttttttgagacagagtgttactctgtcacccaggttggagtgcagtggtgcagtctttgctcactgcagcctctgcctcccgggttccagtgattctcctgcctcagcctcctgagtagctggaattacaggcacgcaccaccacacacagctaattgttgtatttttagtagagacggggtttcaccatgttggccagatggtctcctgacctcaggtgatccgcccacctcggcctcccaaagtgctaggattacaggcatgagccaccatgcccggccagtagaaatcttttttaagaagacttttaaaagctactcattttagacaagcctttcttaattgtgtaagaatgcttggaaaaaagtagtattttactatttttaataaatctgtaaaattattgatgactgctagcttttctgttttgcttcatttataagtgaatgaacagtgattgttgtgggttgaataacattccccaaaagagatgttgaagtcgtatcccctcatgcctgtgaatatgatcttgtaggaaatagggtctttatagatataatcaagtcaagatgaggccatactgaattggggtgggccctaaccctatatgaccggtgccttataagaagagaaagcgcacacacacacactctcacacacggggagaacactatgaaaaaatggaggtagaagttgcaattttgcagttgccctgccttaagccaaggaacatgaaggattgccggctactgccagagcctgggagagaggcacgggtgaacattctccctcagaatctgcagaagaaatgagccctgccaacttggactgtggatttctacccccagtactgtgggagaataaatttctgttgatttgagccacccagtttttggtactttgttaaagtagcctgaggagcctaatacagtgacttcctaatcaaagaatgtggaggcgcaattcaagtggtcttttcaactccaagaggattgggctgtgtttgttatggttaaaggaccattagcagttgttgaaaggataaagggaaggtacttcagtctgatgcggagtcagtgaggacacccaccgctcccctgcagagcagtgtcttgagagagaaagggttctcctctctgtaggagaagcaagctccattcctggtgctcctctgtatgatgggcatggctacctatgcctgccctccagaggggaagaagcctttgtgtttaggaccccgggatgatgttgacagctatgatcacataataataattgtatgataatgattgcagataacatctgttgcgtatctaccatgtgtcagatctagttaagcacttcacaaatcaactcatttaatcctcgcaagtatatagtccatgaaggtcatattattacccttattttacagacgtgaaaaccatgatagagattcagtaatttgctccaagtgacacagtgaatgacagagctggaatctaacccaggcaaattggctccaaagcccatactttcagcctttacagtttagcaaggctgcaccagaccccaacaaaaactagttcttttgtataacaagagaaagattccctggctgaattctagcagactagattcctcagtgccattacgggctgaggacttacaaacatgaggaaaagataatggctagtttggttttctaggtctgccttagcaaattaccacaaacttggtggcttaaactagagcgacttctctcaacagttctggagccagaagttcaaagtcaagcatcagcagggccacatccctctgaaggatctgggggaggatccccttcttgacttttccagattctgggggctcacggcagcccttggcttatggcagcaaaactcccaactctgcctgtctccacaaggatttcattgtgtgttcaagtgtcctttctgtctcatgtcaggaaagtctcattggatttaggacccacgctaatttagtgtgatctcaagtgatccttagcttaattacatctgcaaatacccagtttccaaattaggtcacactctgaggttctgggtggacatgaatttgggaatggggaatgatattcaacctgctacaatggccaagaaacatctacctagttcaaaagagaacaggatctactggaaagcttctcagctcttggagccccacaactgtgtctcctgggtcctagccttcagcctggctctcagcacagctctttgcggataacatggctctacactgcgtcgaacagatttggtggcagtgactcacctagcagagttctcagcagcccacctggaaggtcccatcacattgttgttattgcagatagcactttcactgttactcaattttttttctagtatcttgtgaacaatgtgtttcaaagtataggacgacttggtggttaatgtcacaaaagcaatcattggagttgtcaatcacagaatgacattacataaaagaattaggactcttcttgctcaagatgctttatacatgagcataaattgagagttatgtatatttggatagtagaaaagctatacattaatgtgcatcttaatgaggatgattttcttcttttgataaccaatgtgtctatgaagccatctagctaggtactggtgagaaaaatgtttcaaataaagtatttttattggagcatataaaagagttacaaaaatatttctgtaaaattttctggtctatttttttcaggttggtactttttaatggtttagctgttaaataagcttcatctattaacttgtattcagaaataagcttaattattcatcaattcatgctcaccttatattttatggttttccaaatggatgatatcttctatgtctgtacattttttattaaacataagtcattttatgcccataaagcttattcctgaaaaaattattttgctactaaaaaagatcattaagttcacaaattttctctccatggcttgatgctgctatctttctgcaccataattagttgcatgtatagttaattattatgagaaaagcagaacatctcccaatttctacaagatacttagagtttgatggtttaactatgttttctccttcatttctcccatccaccctccagccacgtgtattttcatggtaggaagatgataagcatacgctttttcaaaatgacagcaaaatgttcatcaggaacttcataaagctttgatagactgaatatatatttagaaccagcatttcaatggctctttaccttttcttaagaatttccttatctatgaccctcattgctagaaaaaaaatgcgcacttttatataaacacaacatttttcatataattttaaagagatttgaaaccctctgaaggctatatgtagtccccatgccaagaatgccagatttgggaaccaacatttcttatccatttataatgctaattaattatttctcttaaaaaatactctagttagcctgtaaaattcatttagatgacacatttaattttgcccaaaaccttgatttttttggaggaaaaaataatgtaagaaaatacattattttaggttaggatctttaaattctcacagtcaaccaccatggtttctttgtacgacctaagctcattcactggtgggcaagtgttttggggaccaggagtggatctgattcatctctgtatctgccacagagcctagcatgatggtttagacatggagggagctcaagtaatactgttaccggtacacttgttatttaattttaaaaattaggaatggctactgtgtaagtacataaacatttaagttcataaatttgtttacagttgaacacaaaaaggccatttgtgttcagatatgtgacctggggaagaaagatgaaatgggtattttgatcagcacggggagcagtcagtgggcctacagagaaggcgattagaaaagccttgtgctgacagtgcaggttctatgatatggaaagaactagtgaggaagatgcacatgcttagtagctcctaggaagagttctcaaggagcatcaacctctatgtgtccttcccaaggaagcagtgggccctagattggaggaattcaggataaaacacacagtcctgctaaccatttcttatcccagtcacctgaagggatgagatcagaattactagggaaagactttgcagtgggatagatatgcttccaaggtacttctcccagcccctaatacttcctgtttgctaatgcttaaaatctctctaacctaaaatctccctaacctaacctttcattttaacattagaggaaaaaaaatttgctaaatattgactgaaatttattcaccctaaatttaatcacaaaagtacaagagcaagcatacttcctctctgattccgtgaatgagaagtattgaggagccaaggttggagaaggggttaccattgagaatcggagagggcaccagaggtcaagactggggaaaaagacaaattgaaaagacattctatctttccctaggattgttccaattatcaatcctattagataagcatatgtagaaacctggtataaaagaaattattttgtatggctaaccactctccttcaaaaaacttcacaatttgttaagtttagataaagatttatcctcttgtttgattagtttccttagaaataaatttcattcttaggggtttcactaattaagataaatagacaattagcctcttggcagcagaagctacttcttatttatctctgtattcccaatgcctaggccagtgcctagcataaatattgtgcttaatcaggattataatatgtatatttcttgaatgaagataacaaaaatatctattacaactctaagtgatttattaattgatttgagaaaggatttatgttaacttacaaaagttcattcaataagaggttacatcaaatatttaaatcattgcaagaggaaattagaagtaaagccaatgaaatgaagttatatagctaataaatcaatttttcttagttgtaataagtatacaaaatctttctgcatgtaatgtgtatgctatcagcttaatataggcatgttttaaaccatgataaagaaaatattccaatatctcaaattctttcagaattatgccaaccctagaacacagtttctagtatgtgattaagccttctattttttaaaaaagtatttctcaattgactgctttacataaatcatataggtgtaaatttgaattattactacataaatttttcttagatttatgacagaattaaaatagccttttaagtcttaaaaatattaataagaaaagctcaattatgtgaacacagctaataatacattcattctggcaggcattgtgcaaagttttcaatgaatatgaatatctttatgaaatatgagaagctttgttcatttacatacaagttccttagtctcctacattaattattttttctcattttttcatgtggaaccttttccagtaagttctcataagacaacaaatgacccagtggagtacctatttaaaacattataaacaaagaaagcttctttcttcagccctgttctttaatatgtaatgaaaatgcttcatctttcattacagaaatgttttatgttctaacctcttaacctcattattatagtttggttagatttttaaatagaactcgagtttttctcagtgtttcagacaggaagaaaggtggagtacctgacaacctgttccaggaaagaatgttcaataatcaagcatctatctcctcttcctgagttaatccagttagcttatgaggcaagcatgggggagttgcaaagtaaatcaaggtgctgaattctactctcatcctgatcctaaatggattgagttttgttctttcttatgtactatccccatattcacagttacagactttgcaggtcacttgctgtctttgtcatattgggatgctctaacataccatagactgggtggcttataaacaactgaaatttgtatctcccaggtctggagaccagaagcctgagcccaggctggcaacaaggtcaggctctggtgagggcactcgtctcggtagcagtctgccaacttctccttatatcctcccaagtgggaagaaccagagagctcgttagggcccctttttataagggcattaatcccactcatgagggctccatcctaaagacctaataatccccaaaggccccccttctcatgccattacattggtgattagggttttagcataggaatttgtgggggacacagacattcagttcatagcagtggaagataaggggtgctgtgcagacatcatgggctctatgtgtcacataatgtagcatctcatacagggtaaacaatcgccactgttatctcttcccaaagccctgctgtggggtctgctcaccggccctgcatccagtcaaggaaggggaggtggagaagggcacttgaatgctgagtggcaccaagaggaatgtgcagatgtcataaactggaaaattggggctaaaggtgaaacagcatcatacaaatgtcttccctccaaaagctcaatcttattttagaaatatatgatccatgaggactttatcataaattggcccaaaacagccagtcagctactgagggtcctcattttccaatgagtgcatgttttgctgcttcagtggtccagcacgatttggaagtattattgctttgttactgaagagacctttgttttgattcagttgccaatattctctaagatggtttaatgtgagccatggtacttaggtgtaatcctgtaaggtttcttttcctgggattcacagtccctgctttcaatagagtctcacgagggtctatgacccttccagacagcactgatttcaagtctgtatcactttataaaatcctacacatagtcgtgatcttagaaaaaaaatggacacaatatagaacacaaaaagatgaacccattactaacaaatctccatatatccattgtatctaagtcatactctatgagcccaaaggctaataaaaaaacaggatcagacccaggtacaggggcaacagtgccaacttctgaaagcagggatattggtgtagcgaaatagagaatatgaaagaaaaaacaatactctgtgagaaatagcctagtagcctatactttatgccaataagctttataggaagttctttttttttttttttttttttgaaacagagtcttgctctgttgccctggatggagtacagtggtacaatctctgctcactgcaacctctgcctcccaggttcaagtgattctcctgcctcagcctcctgagtagttgggattacaagcatgcgccaccacgcctggctatttttgtatttttagtggagacaggatttcaccatgttggccaggctggtctcaaactcctgacctcaagtgatctgcctgcctcggccttccaaagtgctgggattacaggcataagccaccgtgcccggccataatagtaacttttatatcccagacaaaaaaaaaaaaaaaactgagttaggcttacagacttgactctgaggggctcatgataataattttcttttttttttctttagttcgtttgttttagcatgtgctcagaggaaaaagaaaaagaatttatggaagaaatctctaaatcatattccgttctttcatgaaagtgggcaattcaaataatttcactcaattttcaagtgagatattcacagtaatttgtatcttcaggttgaggctaagcttcattgcacttcatgggaatatatagaacattctagcaaatctttcttagactattacatctttgacttacatgtttatgaagaatcatctgtgcctctgattggccttatataaatacaagggtcatttcagagagcagttcttaactgacttggaaaagcctaagagccaaacaattcagcagctcttccacattgatggcaccagccacatgcagtacatgtgctttacgcatttcattattgcatctctttgtcttatgagtttattgatggaaaattgtgccttgtcttttatcaagtaaacatatttcagaagacatctacatgctatcaacaaaacagagcaaattcagaaaatgtaggacttcgttgtacttgggggattacttcaattgccttaatagtctaccagagtagaaatattacattctttaaagttcagataaataatttgtgctgcttatgtaggaagtaagctattctccactgtaagcagtcttttatgttgacaatatagaaataatctgtcttataagctacactgcatctaaagccctgacactacagatttatgcatacttctggctgaaaataatattgaaatgtgaaaatgaaatctttcaccaaatctctgggaacataggtttgaggctggctttggaatcactaaaaattcattgattcccaaacgtagactaagtaccataagaactgactagggtacttgattgagcttgtgctgtatggtttattacactggtggtaggaatgtgtcaatagtgattatactgctctaagtattttgttttagggtatgattctagcttcccttgtatcattactcaaaactccaaatgaagtgtgtaagagtatttttcaaccctggatttacttgcattccatactcattaaatatatgacacaataaaatgtctaggtcttatgcaaggaacttcaactcttctatggctcctggcctaaaaaggtatctgtgagaggcagaataatgtccgccaccaaagatgtccacatcctaatcttcagaacctgtgaatatgcgaccttacatggcaaaggggatttagcacttatgactaaattaaggatctataaatgcggagattttcctgcaattcgctgggtaggtagaatctaatcacatggatccttaaaaatagtaggaggaggccgggcacagtggctcatgcctgtagtctcagcactttgggaggccgaggtgggtagatcacgaggtcaggagttcaagaccagcctggccaaaatgatgaaaccctatgtctactaaaaatacaaaaaaaaaaaaaaattagctgggcatggtggcggttgcctgtaatcccagctactcgggaagctgaggcaggagaattgcttgaacctgggaggcagaggttgcagtgagtggagatcacgccactacactccagcctgggtgacagagcaagactccatctcaaacaaacaaacaaacaagcaaaaaacatttgaagcattgagattaaagtgttttctttgattaaaaatctgtcaagagtaattagaacctgcttcctttcctcttctcattgtacagcttacaatatggatcaagaaattgtttctattgacatacttctttccatgtttagatcggcttccaagatcttatcctttccactttcaatgtcatgaaaaatcattgagagttcctttaatgcgaaatgttatgccagtgtcacttcctgtgagacagcttcatcctttttggggtcacaaccaccttccttatttgtgtagttcaattcatttaacctgagttcctctggctacaaatctggagtctctgaaacaatgacacattcagctattgcttctataactccatttacattcatttcacatttcactttcagcatcatcactctctgtttcttgatgcacttttatcttagttagccaattctcccttctcgtgtccagttttgtaaagtgttatatgggcttatcactgggaaacaaggaggcaacataaccacatgctttgctgtgtgtggaaagaataacattatgtggagtaacaaacccttaatagattttgaaagaagtgacatggttggtcactgatcatgatgcacatctgttatttctgtatagatacttctgaatgcacaatgaggttatgtcccaataaatccatagaaaacacatagttgaaaatatatcaaaagttgaaaattcgtttaatacacctaacctaccaaacatgatagcttaacctagcctaccttaaacatgctaagaacacttacagtagcctagagttggaccaaatcacctaacacaaagcctattttgtaataaaatattgaatatctcatgtgatttatagaatactgcactgaaagtgaaaaacaaaatggttgtacaggtactcaaagtacagcgtctactgaatgcatatggcttttgcaccttcctaaagtacaacaattttaaggcaaactgtcataagtcagggttcatctgtagtgtttttggacaggagagctagtaacaaaacttgaacactatacatatgcataattaaatttgtatattatgcaattactcaaacttagtatagcacagtaactaaaatttgaaccatgttgggagactggtatatttacctatactatagtaactgaaatttatgcatattaaagtgtgtgcaaagcaaggactgcctctttgtgtgtgtatgtgtatgtgtgtgctctgtatgttttgcatattttcaaactttaaataaatgccatcatataatatttatccttttatgaacttgctatttacattcaaacaatgtttctgattattcttattaatgtatgcagtcaccgtttatttctttttctgttttatgatattccattcacatgactatactacacttcaagttatttatgtattctttattgaaaatatatattgctttcagttttttatttttgcaaatatgactcctctgagaattaatttattgcttccatgtagtcatgtgcaagaatttctctaaggtaactatatctaggtgtggagttattcagttttaaaccttattagatatttccaaattgttttcccaatttacactttcaagtaagttttaattttattttgactcaacttgctccataacagttagtattggcaaattccattttaccaatctgatcacataaatgaatgaggctaaactaatttaatttgggttttcttgattaagggtgagactgagcatattttcaagtttcctcaaatatgagttatctgtatcttttgataattatattaatatatattatttacataaaccaaatattaatgtttataatttgtatatactgcagctgtcatctcctaatctttgtcttgtctttttatttgaattatgatatattttgatgtgcagaagttttaatttgaatatagtagaattcatccattttcctttttggtttatgttttgtgtcttatgtcataaaaatattatcttttgtgcttcatgccttttttcttttatgatgtcttttttcttttaaaagttttaaccgttttctatgtttgggtcattaaaatacatggaactcaatttttttaatggtataatctaagggttcagtttcttatttttgacacatatacaaccaaattttccatcatcaaacatgggaaaaattctttctccactgaactgtaaagccacctctgtcatacatcaaggtttttttttttttattagactttattttttagagtcaatttaggttcacagcaaaactgaatagaaagtacagagatttcacattcaccctctgcccccacatatgcacagtctcccctactgtcaacatccatcaagtttttatacatgcaagggtctcttttgggctctatatttttttcctttgttcacattgtcaatgctgcacaaatttcatactgtgctagtgatacatcttcataatagaacttggtttctgatagagtttagtctacagtgttgatttttaataaagttcttaaaatttctaactaaaattcatgcaaattttgctactgcaaatagtatcttttaataaattactttttctaatgattgctgatagatagaaatgtaattttttgataatgtgagacagaattcacattacatataattcatccatttacaatgtaaaagtcaatagcttctgttttttgaaattatatgtatatatataatcatatagtgtgaattctttgtgtctgacctctttcagtcaacgttatgtttctgatattcaagtttttgtgtgtagttatgtccatttatttttatcactgtagagtatcccatcatataaatatatcagtatttgtgtatcctgttttcagtttgggctattgctgattatacatcattattctagaatttccttttggtacattttaaacctgcccactctctagagagtattttattattttctcacggttttcatttcttttggtctgtcttacaagtgtcttaagtatatttgttttgtatcttttttataattattacattaccttgagggtttagagggtttttctggcactttttcacagtggcttatttcctcatctgttttggtatttttgttatctttctgcttatcccttgcaccttgcaatgtgtgagactcattttgtcttaggttgatgttgctctgtctcaacaggatttggatttgcttatacacgtgctttgatacataatctaggttgggtttatgttcatttattggcttggcttttcttggactctcaagtagtgtatactcaaactgtagacctctgtgagggcaggcctgtggttatgaactctcaggagaatagctcttccttattcagtattctggccaagacagatgacagacatttcctatggccagtagtcagctgtgtttcctagaacatcctatcattgaagatgtagccttcaggggcctcagccctgtgcatcctctagattcccaccacaggggagcccagggcactttcctgtccctggaatgctgtgcaattcaatcctctcgctttccaagataaaggaatgtccccagttaagggccagctcaccactctgatgttcttccccatttttttggtttttgcctttttgtttatttctttgtttaagaggggatgttgctttgttgcccaggctggcctcaaactcctggcctcaagtgatcttcccccctcagtctcccaaagtgtcgggattacactggcatgagccatcatacccaacccttccccttctttttctaccattgggatttatcttgctctttcgagtccccagctataccttaaaaaagacacttgttaatttttatgcagcatttgtgggaattattttagagattttcagaacccctagtctgtcataataccaggatagaaagtagaatggtgctggccagggcctggggagatggagaaatggaacattgctgtccaaccactgtgaaatttcagttatgcaacaggcataagttctagggatctgctgatccaccttgtgcctgtaggtaacaatactgtatggtgctcttcaaaatttgttaagagggtagatctcatgttaagtgtttttaccacaataaaaaaattgttttttaagagttgaagactattttctgaataaaaacaaaatgaaacctcataagtaaattcagagttgcctagtaaaatgtgtcacacgcataataaaagtgtaaaacattcacactcctcactctcatttaattatcaagaattaattaagcttttatttttcttccataaattccaagttcccgatagctaacttccaaagctaaaagtaatgttacttttgactcttttgctacaacaaataatactacactaataccctggcatgtattgtgtggctatgtagagtatatctgtaggaaatgttggtggaggtggagctgctggttaagggtgagagaaattttaattttctagctttcaaattataccattcagcctcccttttgtaaactgttagtttaaatttgcttttctgtaattgtacgtgagtgacaattattaaccccagttaaatgaacaaggagttgatcatctgggggtgttcacagtgctgaaattatgaggaaaagatgtggttcaggagaagcttattaaatgtactttcctttttctccacccccacaccaacatgctgacaatagaaactcattctcaaactgaccttattcaaggtaagaaggtattgttccagtgtgttggtttcaaggactttcttccatgcagaataaatagtagaactaaaatatcactaaacctctaagtaagcagattatgtgctgtcaacggtgaatgcccaatatatccacagcgcaagaacttaagtagacagaggtattaactgtcattttatttgaaggaagccaaaaaatcttgtgctcacatcatattccttaaaacctcattcttccagaatggctaccacagtcccaggcatcacctggagacagagacataatacccagcagaagaaaagagtttattattttatgatctctctgtttgaagaagaaaaaatacaacactttcttaaaaatttctaagtggacttcctcttgtgtattattggccaaaattgaattactgaatcatatgccaaccccaggaaaatcaattattggtgtgaggaatagaattcccctgatcaccttagcctaatcaatttgtatccatgacttacacaccctgcaacaaaggaaaatgtaggacttgctattgattacgtacacaagtgtgcctgatgtggacagcaaataagtttgatggtattgtttgtcataaagttaagtaacagcatgagtaatatggccctctgtggaatttcttggtggcagttgagcaaaatttaaattgctctgaaatggaggactgtgatcacggaaacaaggtagagttagctgatataatttggtacaaggaaattaaccatggttgggtttttgagccatagatatgataatactcagaaatatatgtaataatgcagcattcccaaatgattccaatgttgagttctccacacaaatcatttcattttctttcagttggtgttaaagatattggagtcctcatttggaagtcactcactatagcatttatgggaaaccgagctctgaattacaaacatcgagttgacaaacgaaaatctggaacagaacccactcaccagctggcgaccacccagtattatttgactttaaacttgatacttgaacatgattttttaaaagaaacttaagcaagtaaacataaaaaaaaaaaaaaaaaccacctctctttgacttggtcttgcaatgggctttttaccgctttgaaatggaatacagttttatttccaataaacagcagccgtaacaaaacttcacacagacacctggagaaggggcatttgatgaatgcaatactatcattgtttattatagaattatttactagaatctggcagagatcctaaacaccatttaccataactttggccaattttcctaaatccatacttcaaactctactgatataatgggctgctttagccaagaatgatagctctgttactccccaaatattaccaaaacaaaggcgtggtcacttcccacaaatccacctggagtatgagtcaccagctgccccttgttgatataaagagctcgaagaatgaacagttttgaaatccattagtgaatcactgagaatccactcagtacagcttggagatctcaacagaagccaataataattaaagaaagaaaagctctgggttaaaggaaagcaagcaatccagcggaaccaactagaaaacatcagccaactgcagcgccttgctggaattagggcagaccacagtctagtgcctgctagagcaattgaaggaagcccagctgagagagaaggcttcagtaaagaaaattagggaaggttttatttttatgtgaagttcttgtgagaaggatgttaagagaaagcattatctgttattatttatgattgttgagccccacaagcaagcctttgagtttttataagcccacatagcatgtttttttgtttttgtttttcctgagggtaaacacttttatttgtaacagcattgtccatggctgtcaatgtatctgatggaaaatacctgtccataagcatgaaggaaatccatgatcttcccctttaatttgcagaacattacatagtatttttttaaaaaagatgcaaatagcagcctacttctttgctgctaaagagctttaatggaatttttagtgaatcagatgtgtaagggctgatgtcctccaagctgagctggatctccccagttcttcctaaggttccttttgtgtcacattcaactcaacagacaggaagcaactctcctgcagtgaaggccgcacagtgggctctgctcctaaatccaaggacacagaggagcgcctgtgtccccaaatcaggaaggcgggcatcggcgagacccagtgtcacagagaacgagcatttttgctgctactgttctgtgcaagtgatcacagcccagatgtacagtatgatttggaacctccacactatttagcatcccttaatttgtatccagtgtgctaactgacctggaaacattagaaccccatttccaagtttctcttaaaaatccccaggtcccaacacacaccaaccactttcatcctcaacagggcatgttacgccagagacagatccttctgcatgcattttgccttaatgccagtaagaaaattgattttttgtttcaggatttttcaatccagaagacaaagagattagtcagcagcttttaaaatgaaagtttccaggtgagagatttcaacactattttgtagatctggtgaattaagatacatattttcagtattttaggaattcaaattctaatcctttccaattcaccaactccctttatccaaatccatggaatcagagtctaatgaaaggggtacttagcatttgattccaagctttcccttacaactacatttacaagaaagtattttgaagctgagaaaactgacaggtcctgtggttgatctgcacagttctatttcctttgggctccaaatgttaaagcacatgccctggcaattcgggcaccagttttgaatgaagacacccagcatcttgcacctgcctgccaatctccacgtcctttgtagaggaccggggtggacatgcccatcccctcctggggaagtctgtttacactgcaaactcctgacttctgcatggcggtagagctgattgtgatacctctgtccacctatgccagcccaggtgcctgacttgtgttgggttaactattctgatagctttgatatggccttcccacatgtgccttctcctactgtggccgctgtcactctgtctccactcccatgacacttggatgctccagtgacaccagctcctgcacagtaccactcttcagcagcgttcatatcaaactgtgcatgtctagcttatctgggggaagacactgaagagaggcagaggtggagacgtgaaagaagacagcaaaatcacagagcttcgcaagagaaactgcttgcttaaagataatttcttcttctgattacaaaagttacacatgctcattgtcaaaatgctggaaaatacagagaagtttaaagaaggaagaagttaccataatcatactacccagctaacatttcggtgtattggtagtagggaaatttctggttgtcaaggaggaaggtatatatccctaatcacagaggttttttcatgctcttaggtcctaagttatagcattttaatgggagatttctaagacggaaggtatttctggaatagcattccttccctttcttctgcagatctgtcaaattgttcagctttcttgactaatagatgctatggatagagcatccctctctctctaaaaatctcaaaaaaagcaagtcttatttattcaggatttgaagagaaatattcaggaaggatatttcatcaaacctgattcatatattatgcactgtaatgatgctagacacaaaacacaagatttcttgatagatggtcagaataaattacaccaactgcattagctcagcagcagtcctgcccggatctcagcacctgagcttctcatctgcgtatggttgctcagcttggtcactgagacatgcaaaagggaaatgggcattttccctgaacacctaaatcctttccaaaatctgtcaaaatgtttactaaaatgtagcttctttgtttatcagacgaactgtggtaacagcagttatgaaacttatcacagttcatctgataaactacattttagtaaacatttcaaagtgaagcagatatgagagagaacaaaattatttgtgtttacatgagacttggaattgttaaaatttttatatctagcatacaaaaaggctgcttatgttaaaaattgatagtaactaaatatataagaccaaaagaatactaataatgtgaattaaaatgaaatcttagcttggtttataaactatgaaatttgactaaaatctattctgtatatatgttctagttttagaatataaactagaactagaatctaagtagtagccaattggtaagtagtgtctgactgggatctaaaccagttcagattaaaccattgcaacactactcagaaaagcgtatggtcaagatcttccgctatggagattaacaagaaatgcccatctatgtaacagtaatttaaaaactgatagtggtatattacattccagtgaatgacgtaaataatagcctttttaaccctcttgcgaatatacatggtatttgagaaaaacgttgcttcagaacaggtgaaagaatatgcctggccaaaataagttcggctacccaaaatggtaatggcttaagccttttggtttttatctttgttaaaggcagcgagtgacattttaatcttcttgtgcaggtttttctaaaacacaaaacgctttctgttaaaactcgccacaaaggcagaaagggaaaagcattcacagatgcacacagattccaagaactctctcacactatctcaggaactcttactgctccctagaaactgtttttcatcagaatggggaaaataacacgactggtacctgcaatttctgacaccaatttcacatctaacctctgtaggtatttaacggactcagggcctaactgaaactgctgctaactattgatttgttgaggtgttcatcccaggtggtttatggggactctgtaaatatgggctgataatagtaatggtcaagctcccataatttcttaatttcagtttatttatttataatatttatggttgtaagatcgaatctggtgattatctgtgctgggggcagaaatttcatttctaaaggatggcggtaaatataagcatgttgttggttgaatgttcaaaaacatatttcaaaaaccaagtactaacagctaaggggaaaaactcacacaatgaaccagaagtgtatgaaacaaggaataaaatggaaaaggagaaggcatgaatgttggagggatttaagttatggatgaaactacagtgaacattcagggtatgttgggagatgaaaactgaagcatccttttactcggtagcaaaagtgaccgggatcaagggtcactcccggatacaggtatcccggagcacctccacaatggcttccagcccagacctttgtcgtgggaaggagtcccatgctctcatttttggcacaaacagagtttgactctcaccacaaaacagcatcaaacaatgtcacaggctgtgcttctcacaaggttttttgtttgttaagttcattttcctgaactcaaacattgtgggaagaagtaggtcataatatccatttccctctaaattgatccagagcttccagaaatctgaagaccagtgaagccaaggtttcttccaaacatagagttgtgtgaaatcactatgtaaaactgtcagcattattttggtggcaagttctgtccccatcttggctctcctccctgcctctcccacagcctggtacagtcagctatagagttcagccctgaatacctgctggatttacacctagcaatgcatctgttgatctcactgatgtgaaaatcattttacaaagaattcccactgcattttctttagcatggcattcacattcccccatagtgtggtcccaaatcactcctggtcttcatcttctaggttcctcagaggggacctcctagcatcagtctgggaattctctgtctcctatgggatccaggacctggaccacccagtgtccttccaacaggcctgaaaccttcctatgtgcaggtgtggaatgctgctttcgcttcttgcctcccaatatcttattgattcttcagttccttgttgtaatctccctcattcagagttgttttgtgtttgtgttttgttttgttttgttttttgagacagagtctagctctgtcacccaggctgtagtgcagttgtgatatcttggctcaatgcaaccaccccccaggtccaagagattcttgtgcctcgggctcctgagtagctggacttacaggtgcatgccaccatacctggctattttttatatttttagtagagacagtgtttcactatgttgcccatgctggtctcgaactcctggcctcaagtgatccgcctgccttgccctcccaaagtgctggggttacaggtgtgagccatcgtgcccattctcagggtattctttttttggggggaggggtgtgaggggagggtgaggagaatggagtttcactcttgtcactcaggctggagtgtaatggcgtgatctcagctcactgcaacctccacctcctggatgaacgattctcctccctcagcctcccaagtagctgggattacaggtgcctgccaccacgcccagctaatttctgtatttttagtagagacagggtttcaccatgttggtcagtctgtttttgaactcctgacctcaggagtggtccatcagccttggccttccaaagtgctgggattacagacatgagccaccacacctggccagagtattatttaattctctgagtaaccagaagccaaaggatattgcttcacctttagttgccatgtaattgaggcatacctcatcatcagcagtacacttggttttctatactggattacacaccttttggaggcaggggctacttttattcttctttaaatcttcacctgcactagcatgctaaaacaaggaaaagaaagttttatcttctatactggaaacaaagaaaaacaagggtaattcatcttacttttatcactagtctccgattaactacatgttcaagtttactgtatagtatatctatgtgatctaggcaggcatatttcccctcaaatatataatatggcaaaataaagtgcaagttgtgattggtgaagataaatgactgaacttttactatcatattctcactctgctgataaatcatctttgagaattcgtattaattttggtcaagaaatacacaagttaaatccattttattcttttttttaacattgggaggactaagtgaataaagaaggagtgaattatatgattgtctaccccacagtttcagtaaaacgatattttttcctgcaatatatttatgatctgccttaaaaccatagaatctggcttaagccaaagcaactgtatcttcctttattttttaacaataaacacctttaattatcttccttccgactactttgttgtaacacacaatgtgtttgtctcctgaggtgagcataaaaaaggagcccagcatgacttgaatgctaccgtaattaaagaaaagctaaaaaggtcaaaaacaagaatgtggtaaatcttaagcaactccccagaacaggcgccacctgccactttgtgctgacaccgtcaatcattgaatcggttactgaatactttcttgcatttcttcttctccaccttgtgcccacgttaagcaggaagacatcatattttcattagcacctgttttgttttttcaccttctgtagactgttgagtgaatttctaataataaagccaaaaggaaaaataatggcaatatgattggacaagcagtttcagaatcaaggtaggatgcctttttgttggtggaggttttttgtttttgttttgtttttggacttattctccctcatatcaaataaatttattaaacacacctgaacacttgttatgtgccactgtcggccacgtattagggacacggaagaacaataagacatactccctaccaaaagaggcttatggtttagaaggaagacacagtcttgtaaacaggtaagtaaaataaaatgtgagctgcactatgctggaagtcagcccagggtggcccaagtagaccatagccagtctacataaatagggagacacgggggacagctttctagatgtccctaacgctgaatcctaaaagatgagaagcatttctagggtgccagagtggagaaaacacctgacttgtgggagaacggaaggcctcgtgttcattcaatggatcaactatcattgggcatctccacctgcgagagacggcgctagcccctggggatccagtccccggtgagctggaaagctactctgtgctctcagaggacttggaacagagaatgcagacagggtggcaggaatgcaggaatgtgctcacagtgcaggaacccggtggctcgcagagaagggcaccaaacttagacctgggagatcaggaccctctcccccaaaacctggaggattgctccaaagctgtaccgagtcagtggcggaggccgggtgagcgtggggaagggcatcagacacggtatacctgctccacctttcccttttgttttgttgtcacaagaggcactacttcgctgcctccgtctcctctgtgggtggaaaggatggacccaaaggaacagaaggctgtggccactcgacgatggttttgatagggacttatcttgctctctctccctggacactctctttctaggcctgcagcctctctcctcccttcccatttccaaagcctctgccccaacctgatccaagtattatatgtaaacctgtcattagggttctttaaatcaaggctttttgatgacaaaaagagggtttaaaaaaaaaaatgtggctcacgcctgtaatcctagcactatgggaggctaggcaggcagattgcctgagctcaggagttcgagaccagcccgggaaacgcggtgaaactccgtctctactaaaaacacgaaaaattagccgagcgtggcggcaggcacctgtagtcccagctactcaggaggctgaggcaggagaattgcttgaacccgggaggcggaagttgcagtgagccgagatcgtgccactgccctccagcctgggtagcagagggagactccgtctcaaaaaaaaaaaaaaaagaaaagaaaagaaaaagaatctgtaagaatatccagtgtggcttctgcctctggaataagtaatagtcttagtgaccatggctatgggagtacccgggttccatcagtgtgccctgtgtggttttggtctgggctgcattggcgtggcctgtttttttgtttttgtttttgtttttcccttattactgttcgtggagtgttttagtttgcttttttgtttgtttggttggtttttttttggactctgcgaatggatgtctaatgctctcgtctccctggcaggacctccttcctgtgtctgcagtttctcttgtagccacaccgtctgcccgatcatcagtgctaggaaaataacgatgagaacagacctttcgaagcccgattatcagaaagagtgtcttcatgcttgaaatctgaatataaaacagacgcccctgaagtgcatccctgtgacactgcctgtacagcaccgttaaatatctcatcggcagtaatagcttaagactactgtgctcagtcacttctttgggtgtcactcatagcaatccccatccctgccatcatcattatcacacagcactgccataatgacaattataaagatgttagaaagctgagacaagtcattctgaattaaaccgcagctcccataggtcctctgaaattacccgtttccaatatctccattgtttccctacccaaaagcaaaaaggggagacaaatgtctcttgagcgatgcacaaaatacattataagcctgggaataatcaaagctaactgtgttcagtagagagagatgcactgtgactaagtttcactgaattttaatggcataatttttagcccagaaagcaagctcatgtgtgccggagtgattaatgatacagtttatgcagctcattggtcatacttaaattagtttaaatattcatctgttgttttgttataatgaatctccatgtttctttttatttctgttcccctgagtgtttcctcttgtctggttggaggatgtttgcctgaattgggaaagaaatgccaatagccctgtaggtgacaatgcacccaggctgctgaagatcaggggagatgaggcaataaacgcttcatttcacactgtgaaatgcacacacagctgcaccagcttcttgagtgagatgtcttggtggattctgtgaggtgccaggtcagagattaaacttactgatttgtggcacatgaagccattggatgaagttggatgctgtttgctgtccctgggacttcctttaaagtccacacatcaatttttataccaactccctgaaagtcctccttttatgagcattcataatttacattttgagttggaaagtcctgtaactctaccttctgggattttatgaattttcctcccaaatacaaaactctctagatgctgaaattgcatttgtggtgaagaagggaaaggccataagagtaacttaataagacttcatgttacagaactgaaagatctttcaaattcacataaaaggaggcctgcacttgacactgtcctgactatataacaacatctagaagtagacagtgttgcctttttatgctatatccttgggagtacaatttacaaatagtctactacacacttcttgcacttgtgaatcacccatatagatcaacctttaaagtgtaaaaaaaaaaaaaaaaaaaaaactttataacatcctgagaattaatccttggagagctggctagatacagaatgaaaaattccagacaccacaagtagttagagctcagcttcctggataaatcagttaatttggaaattgtggcctccatacccgctaggcatgtttgttcatccattgttctcctccctatctcctagccacagtgaaagaaaacgaagtgtggtgtacacacacttctagctatgaaagcagctgcatgatactggaaacacagtgtctccaaatgtttcagccttgggggcttccctcattattactatctgaataaagtgcttcagtccgctatgatactttactctaggaaacccagctttgttcctcacattatcaatgacttccaggagtgttcaggaaggacccaacttttacactcactattcaacatgttattaccatgctgctaatgtttagctttcttctacattatttgacccccaaaacagacactataacccaactaatataattctgttatagcatgttacaagtttttagcaaaggtgagaatcatcaaattgcatacgggatgttattattcttcatatccatcaaagtacaggaagtccttcacaggcagccatctttttctctgggccacaccagagaagccccctgccttctcctttctttgagtttcaaggactgaacttcatgtctcacaagcagtcagaggtggaagcaaatgaaattgcctttgcaaaaattctaacagtgagaggaatctcacctgactccatcttgcttctaacctcacaagctagctgactttgttagctttaaaacaaaaatgatacatcccttcctgaaactaacccctccttgcttagggactgaaaccatgtttgtaagtctaatgaaaggacataagattaggattatgggaggggcctgaattctgctaagatatatgcatagttaaacaataaccagctattgttccagaggtacaagatttgtaacttctccaactgctcctttagataatatccatatggtcaaaacctaagattgggctttgaggtattttccagacttttgcatttggtttgaccagctgatgccacctgaacccaagactcataccagggaactggctcaaccagtcctgtgaccttcatccagatactgactcagtgcacaaagaccattttggacattcctatgatttaatccccagtcaatctgcagcacccattccccatccccctacccaccaaattaccttgaaaaacactagcctccaagttttactatctctcatccttctcttggctggccctgcaataattaagttctttctttgctgcaatacctgctatactcaatgcattgacttttctgagcagcaggcaagattaacccatcaggctgctatacaaatacttcctgttaccttagtactcaaaacaatctatggtccctcttctcaacctttctttcttgattatttaatctctgttaccattcttacacttacttacttgcaataacataatacttactctttctgtaataacttgcaggttataattggatcatgagtgacctctccccaaattcatttatctcatcttaagcctaatgaatgaaaaaattatccataatgagagaaaacagcaggatccttttcataaagagatgtttgaaaacaagtatttttggaaataatatattaagatgcatatgtggctatatgaccgattctaatgtgtttaggccttgctaatatatcggtatgggacaatctccttcttaaaattgtcacactgtattgtttgcttcagtccaggatagcaggactttttgacctgaaaggaaaaggtaaggcaagggcagaggttggacccttgtcccttaggacaaagcaggcagatttacatcactgccttccaggaaatgacagcttacccccaaaagtaaagaaaaagtgtactttaaaaaatactagccaggtgtggcggctcacacctgtaatcccagcactttgggaggccgaggcaggcagattgcttgagctcaggtgttcaagaccagcctgagtaatatagtgaggcctcgtctctacaaaaaaaaaattttttttaaattagtgtgatggtgcaggcctatagtcacagctactcaggaggctgaggtggaagggtcacttgagtccagggggtcaaggctgcggtgagccatgattgtgccactgcctttcagcctgggtgacagaacaagaccccgtctcaaaaatatatatatgttttatacttctcactatagaaaagccatttaaagcattctgtgtagggggaataaagtgagacacaacctgagtattataatgagcactgaatttgtagtaaaaagagtaagtcagattcttgatttgcctcctgcaggctttgcactttgaaaaaattatttacattctctgggctttggatctcttgtttttaaaattcagagtttgaaccagatacccgcccacctcatacagcttgaaaactctacaagactcaagtttaaaacttctgcattccaataaaagttagaaccctaatcctcttgctacaggctagcaagatttctcgtatgaaaataatgacactgcaaatcagtacctgaggtctaccaaaacctcatgttgtcaaaaccaaattgtcatctaactatttgaaacccgccacaaccctttctcgtaccattaatgtcaaagcacaccctctgagcagaggcagcagtcactgttttttgttgttgttgttgtttttttctgagctttctcacatactaacagaggctttgatgcaaaatatagagcagtttccgacctaagggactttggaccaacagatatcatgctagccctaattttttctgtgggttttcacacgactgtgtgtgagaaaagcaagagatttcagatctaaacaagacccactatacgaactaatgaaaatattgggtgtgtggtctacaaaacagcctaaataagtacttctctctgaaagatccctttctccataggcctattcagattaatatctagttttcttcacattaaagtgtatatgacagttgtcatgataacttagtgaaaagtttagccaatagaatctatgtagcacttttaggcttctcctgctgtctgaattttttcttaattttctttctctcaaattcagcccacctaaagtttttgacagtctgtttaccaatcaggaaaagatttaattcttatttgtcttaaggcagacatccaggatggacagtgattatgggttcatggaatgttacaactggaagagtttataggattcatctggtccctcattttcctacttgtcaaatgaaaacaatcaccagggaatgtgttgaaaatatagatttttagtctccactccaacctgttgggtcagaatctcaacagacacaagagaatctgtacttttaacaatcataccatcaagcaaatttgagaaacgctgatataatcctatgattttattttgtaaagaggtttattttgattatacatggtcatatatgaaaaaaagaaaggatttcatagcctttcgtgaaagagttgactgcttcatatcagttataaaacataaattgaaaattattcctgaggttgaaacactcaacttgggcctctcaatttctgaaactcttgactttgatgatcgtaaaatgacaatgattattttatgttaattacagaagtcaccttccattctctcccaacctcaataacacctatagatgatatcaaatcgaggcatgtagagccacacactattttaaaaatgtagcattccttcatactcataaacattctcttaaccttaacatatgaaataatctccaaattctcacaaaaatgagtgcccacctgaactaaagtttttttacacctttaaaaatgtaattgtacagacgaaatcggtgtcataaggttactttcactaaaatagtatatccctctaaaaacaactttcacccatttgcaatcactggaaagtcatagaaggtgactagagtaactgatttctctcaagagcaaattcatgctctccaaaggagatcagggtctgtttagaaaactgaggtctaataatcaaggttgccacctggtagatctcatgttccacacatttggatgacttggctgatttcaggaatatgggaaaaatcagtttaacccaggctctctgaaccaatgtctcagatcaaactgatgacccccggacagcaaaaatgtgaccaaggtggaaggatcacttgagtccgggaggtcaaggctgcagtgagccatgattgtgtcgctgcctttcagcctgggtaacagaacaagaccccgtctcaaaatatatacatatgttgtatacttctcagtgtagaaaagccatttaaagcattctgtgtagggagaataaagtgagacacaacctgagtattataatgaacactgaatttgtactaaaaagaatcaggcttagccttcacttcacaacccaggttcacatgggtccttcctgtgcatcccaaggtcaggtttaaccacatcaacctcaaagccttccaaacagaaagcatttggaaacaacaccatctccccagatcattctacagtatgaagccgtgaaactgatggctctcggttcccctattcctggaacacaagtcttcagtttcagatttgggggaagagaaatcatcatagtatgacaattgggagaaaattacgtttttgttttcatatgtctccaaataaaatcccaatcatattttgtacaaaatttccatttttcattattaaaatttcattattttcaggcagccattgaaaaagattgtgccctaccagaatctggatatccttttgggcaacacacttttaacctctcttaggagatgttaatttgagtgagttttcaccattctatctactgcattcgtaaatttccctttttgattattctagtcatgtaacagtgagctcagcaaaacaaacacacgcacaactccaaagttctatgcttaatgtcagtgataaatttcaccaagtagctagaaaagcagctataataaagaatattctaattagtcttagaggcattatgtggcagaaaatatggaattttttttcttatgccgagtttgctaattgcccccaacaataggtgtgaatctcttttgttatacttgcagaaaatatataggtttgacttccatctgggacactctagagaaatgaaggagttgcataaaacttttaatgctgtgaacagctagacacaagttacatagctgctgaaatgaaactatacaacaatttctctatataaacacattctgaaaacacgttgggtaaatggagatattgttgccaccctagaattgatggtttccataaatatcagcatagcatccatactatcttttaattacaattttaaacctgcgaatataataccttgactcgatggtagtctcagagaatgtatgactatattttattccaccacatataaatttgtagaatagggtcttagtgcttagctctgtgagaactatctaactgtctgatgataaaagttgaggagttgtttctgtgaccaaatatgaacataagaccaattatctgcaaatactcctgtaaggtatatttccagtactgttttatgtttggcaggattgtggtggagaagaacagggagatgttctaagtgtttaaaattatttttacatcctagaatcaatgtcttcttaatatcatactctctggttggaaatcttcagaggacagacactcagtgaataacctttaactaatttccaacccatttgagtatgccaggaaaatagcatcttccaagttctagtctagttgttgtatctgtctgtgttgctttccggctgctatagcccagttaaattaccaagtgctgctgatcctttggagcttttcttaatcctcttttgacctctctaatttgaattattctgtgtcatcaacaaagatgtaacagttaggtctctgtgaaatcacaaactagaattgcaattagagtttcttaatcgttgtgcatattgtattgttgcatggggaaagaaagttttggaatttaattaaaagaaaggggaattgtcaatgtacttaatatgccattatattttttcttttaaaatatggagttaaagaaaagtttgattgtctttaatagttgcagttatctaccaatggggactactgaatacatatgctggggaaattcaatgtcaaggaataatgtatgcttgaggaaagtgtcattaaaaaagaatcagaggattagggattctctaagtttttaaaaatatatatattcttagttcttccggttctgggcccattcctttgtttgtagagttacaaaaaacatgattgtttggtagtaattttctttatccagctctttttttttttttttttggcaggtggtaaagtttattcttgtaatttcttgagaagcgtacagcatattttcatttagatgaagttcaaaaacaaaaataaactattaagtgagttagggctacaaaatgtggtcaactataaagaatatcaagggaaccataaacctgaaatctgggagagcagtttcatctgagtcaggaggaaataagtggatggaatcaggcggaagcacgtagcgtaaaagaaaaattgcaccagacactcattaaaaatggcagagagactttctttgaaacgattgtaatatggattaagactattgcagtaggggagagattgaactagactccattggcacaaaagactggaaagttttcaagcatgaagtgagccagagaacaggtactggaagatggtgggacgatgtgattaggccatctgcatttcctaattggcacttccagaatttaggctccttacccttccacagagactgagagactggggccctcccttcttgataacaacatttcaaagggatagctcccgggtccttaagaaaaacactcctgggctgtaaaaggtttacctctcaaagggcagagtaagaatttacaattgcaagttttctaatgtaagtgctctaagaaaagagaagtcaaaggcctagagtcaggaagaaagctgtctgaagtttagtcaagctgaaaggaacttaaagcctccttggtcaacagtaagcttcagtgataatgctgaagtcttgttttctaaaattaggtgggaagtccgctggtcattgtatcatgacaccttacaccttacacatactttaaacattttctttagtatttggtagaaacagaaatactacttaagtgctacttaatagaaagtaaatcaatagtattcaacagaagcagaaatgtatttaatagcactaaatagaagtattaatagcatccagtagatacagaaatgttcggcccagggtcagtggtgttgcccaggggaatagccttcctgggtaacatacgctgagattgctgagtggacaaggtatttccatgtgccgaatttacacagtgcacctctttcctttttcctggctgcactcggtctctctgaagtgaatggcagtatttttaccctcgatttactgaggaggagactcagtcagagaggacattaattgtttcttcctaatatcacaataaattctcattccctaaggctatgtcactccctagaactaagttatctacttagggaagatcattcgtcactgccaggtctccagggtaacatcaaggctttattgttgcaagtcgacaaatcgcctcccatctgtctgccctgactctgtgactgcagccgcgcggtgccctagatgtttccccagtggtctgaaagaattaatgtgcctccctaaacatctaacttaatgctagggaggggcttaggcaatgggggaaatccgcctggaagagatgttctggatgtcagtaggttgtgctaatctggctgtggtcatggctctattggggagacattgacagtccatctatgtctcactgaaagatctttgtgatatctacaggggcactggggaactaacatttcaagaaaataatagcgccagcaggtacagatggtgtctcagacaaagtttctgggctctccctgaagcttgacatcacatcagtgtgtgtgcaactctgcatgtggttggtgagtacaagggcaagagacagagagggtaggagtcagaccgaaggagctaccgtgctggagcccagtgaaaggtgccaggagaactcatggcctctctgctcagatctcaaaatcagaggaaatgacaaagaaccagaagaacaaaggagaagtgacatatgggaggagacacccaagggaaacgttcaaggtcccaacatgacaccttatttgcagaacatcccccaaaacaaagaaatcctctgcacttgttcagaggatttctgatcaacagcagccaacccacagaagcagcagcccttgggcgctaagcagaagagagaaccaatgaggagccattcacctcacctgctgacgcgaaggctgcttgccagttttaggggttttctatgttgatgagcactttggattgttctgagaaattccccctcaacacaaaacacactctttaatgaagagatcccatattcctggctcaaaaatttgacccttgaatcatttatatcatatcattttgttgtagtccatgaattcatgaaaggcacagagtgacccagggctggatatcagccaggttccacgcagacagagtgactgggatgactggatcccaacactcggtgactctcccattcaccaagctccctagtggtctagaataatacccagccacacacctagcgagggctcatagatcttaaaaagttaaagaactactgccactgagcagatttttcatgtctgtatctgcttgcctgccagatttccttcctcttccatctcattgctgaatttaaaaatacttctaagtctatatacattataattgggtaaaataagaaattcttcgtaatttagaagatgtatctctttcctgaagacttcctcctactccacccccaatctccagagacacatttttacccttaagatccttttttttcctttatttcttctaaaaaaaaaaaatgggatacatgttcagaacgtgcaggtttgttacataggttacatgtgccatggtggtttgctgcacctattgacccatcctctaagttcccttcctctacccgccactccacaaaggcccttgtgtgtgttattcgcctcactgtgtccctgtgttctcaatattcaactcttacttatgagtgagaacatgcttaatcctgagattctgagcaagacaacctcctttagagatgtctattgcttggaatgttttaatctgttagatttttgactgcacatattagctttaagaaattagaattgagcattaacatgttcagtttgttttcactattaatttctccataaattatgttagattgcattttttatagtatgtgcaagtgtatgtgcatatacgtatacacacagagagaggctttgagctaaggatggtggattgcccacatctgtttaaatctccctaccaggaaactagcagcaagcatattacttcttcttaccccctcctatattcctgccaaggagggaatttaaaaactctttcaaggagaaacaggtagccagtgatcatcaaacattagagaaagcattcaccgtgacagaggcaggaaaaagaaaattctaaaagaaaaactctagaataaacaaagacatagtaggaatcataaaaaaactgttaagtgagcaatgctgacatgcctgctcctggtaccattattagcagaaaagtagatacaaaatgctttgatataaatgagacatctatatctatcaggttaacatagagataaagtgaacagatgaatttcaagtgatagaatttcctgtgtgtagcacccacattagaggttataagaggataaaatttaaagtaaatttggaatcacccagtcttacgtcctcattatcagggctatggtttaattgttccccccaaagtgcatgtgttggaaggttgacccccaatgcagggatattgggaggttaagcctaatgggaggtgtttgggtcataagggcaccactctcatgaagggattgatgctgttatcttggaagtggattcatggtcttgggagtgtatttcttataaaagcatgagtttgaccccctcttgccttctgccatgttatgacacagcaagaaggtccttacgagatgccagcaccttgatcttgaacttctgtgctttataaattacccagtctcaggtattctgttacagcagcacaaaacagacgaagacagaaaatgggtaccagagagagcagtgttgctatagtaaatacctgaaaatgtagaagtagctttggaactgtataatgggtagaagcctggaaaatttggaggagtaggctgggaaaagcatgcattgctatgaacagaacatttagggtaattctgttgagggctcagaagagaagaaatataggggaagtagagattactaagttgttgtgatcagaatgttggtagaaatatggacaataaagggcattctgatgaagtctcagacagaaatgaggaatagcttattagaaactggagtaaaggccattcttgttataaattggcaaagaacttggctgaattgttcatgccctagggctttatggaaggcagaatttaagagtaatggactcggatatctggtggaagaaatttctaagcaaaatattgaaggagttgcatggttacttttaactgcatatagtaagattagagagaagagaaatgatttaaagacagaacttataattaaaaaagaagtagagcagaaagatttgggaaatctgtggcctggccatgtaatgaacagccatgtaaaggtgctgccaagcaaccctttaataaagggattagtacagctagaaagaagccaggtgctatttatcaagacagtgggagaattacccgaaggtgttttggagatctctgaggctctccctccatcacaagcccagagctctaggagggcagaatggtttcagaggagagtctcagagtgccctccttggtttctctgcccagggcggcctagggactctactccctgcattccagtgtagcagtcctcgaccactccagctgtggctcaagtgggcccaggtgcagctggtgctggtgctccagaaagtataagggtaatctttggtggtacctatatggtgcttattttgtaggcacacaaagtacattagctgtggggccatggtagcctctacctagatttcaaaggatgtgttggacagcctcagggcccaggcagagacatggtacagacagaagtcatagcagatttcccactatggcgatgcctggtggagccgtgggggtagggcaaaccccacaaccctgaccccagacctatagagctactagcatgtagccccagcctgggagagatgcaggtatgaaactccaacccatgagagctcctatgtgggctgaacccagcaaagctatacgggtgaggctgcctgagactttgagggcccaacctcaactccagtgtgttcagcacaagaagtcaaactttattctggagtcttaagatttagtgttcaccctgttggctttttggacttacctgagaccagctacccctttttccctgcttattcgtccttttcaaaatgggcatgtctatactatgcctgttttagttctaggattatattttggaagcacataacttgtttaacttcacaggctcatagctagagggaaatttgcctcaagtgaatcatgctgttagtctcaaccatttctaatttagataacattctggactttggactttgagttggggctgggatgagtgaagagtttagagtctattgagatagattgaatatattttgcatgtgagaaagacatgaatttggtggaccagggatgaaatgctataatttgaaactgttccccaaagttcatgtgttagaaacttgatccctaattcagcagtgttgggaggtggggcccagtgggaggtgtttggatcatggtggcactgccctcatgaaaatattagtgccattatcttagaagtgggctcatggtttctggggcgaattgcttataaaaggatgaatttggcctctcttgctctctcttgtgatgctttccatgtgatgcttttccaccatgttatgacacagcaagaaggccctcacaagacacggatgccttgatcttggatgtcccaggctccaaagggacgttttcattccaatggaatgaaaaacaattccattctttatacgttactgagtctcaggtattctgttataacagcacaaagtggactaagacgagcagttatgttatttacccataatcatataatatattagctgcagaatcaagtctagaattctgattcctaatttctagtcccatgtgatttctattacctaactccataaaatggatggaaatgtctgattctataaggaatctcaaagttccacagagtcaacatatagaacacataaagccaactttatgtgtttttttaaatgtaaatgtgactgatatctaatagctaaaaattcttatcaaatagctaattgttacataattagcacaagtggtaataattctaattactttctttcagattttagaagagctatgttgagaagatttgctaggcctctttaaaattttatcctaggaagttttaaatgggggctttacttttctcttgttaaattttccttaagctcagaatccagtattgcccactgatcaatattttcaaagatagatggcatagcactcaaacatttgaagacattactaaggccttgtcttgtgagttttcagaaagcagaagtcacttatatcttgctcccctcccccatcatctcaaactatgtcgaaatccttccaaaatggcaatcttcatgtaaagaattatttaaaaggagcagccattggcttctgacttaatataatggaaggaaattataaggcagatagtatgtgtatcagactgtctctgggccatgtccaatccgcagctgtgtgcccacttgttgcttctcttggtttgtaataaattttaatgggttacatctaggtcaataataaaaaataagcacaatgatcattcaattcactgaactctaagtctagctactagtgttccaactcgtataaaatctgtgttgaactataaatacagtagtccccccttgtccgtggttttgctttctgcaatttcagttacctgtggccaaccatggcttgaaaatatacagtattttgaaagagagagagaagaaccacataacataacttttattacaatatattgttattatttttctattttattattctcataatctcttactgtgcctcatttataaattaaagcttatcatagacatgtatgaataggaaaaaaacatagtatacacagatgattcttgatttacaatgttttgacttaaaaattttctcagctttacaatggtgggacagcgatccatgttctttgacttacagtagatttattgggatatgaccccattgtaagtggaggagtatcttttaggatttggtactacctgtggtttcaggcatctactgggagtcttggaacatatttcccatggataagggggaaactactgtacaattgtaggacttcagtatgtaattaggaaaagaaaaattaatttgttttcataaacaaatagatcattatagtttacatctgtaaacaatcatggtattcttctgtcaaaacctttccatatcttcttattagttacaaaatacaatctaaactatagagcatggtcttcaaggcaattcagtctgatgcctcaacctgtccatcaaccccatcaactgtattgtttcacttcaaccccagatgctaatcactccatatcatccagactgccttgaacgctgtatgcatttcatgaatctgtacctttcccaagctgcttccgcagttaaaattctctgatcctttgagactcagttcaagtatctatgatcctaggaaatctcttcaacaccccctctttgtcccctctcgtctcagcagaatccattgtttcttcttcattaaagttcccatagcatctaattctatttttatgaaagcatttctcagtcacaccttttttgccatttctgtttctgtttccctccccaaatggtgaatcactagaggaagtcaaggatcatcttatagtatccttgtgtctcaagagtttagtctacccctccacatgtttggtacccattaaatgtttctttaattggatttatgtaagagcttaagagtatttcccatgatttcatttgatgcccatagaaactccattaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatctgaaggcctcagaaccgggaaaattattggtgtaactcttagtctgaggctgaaggcctgagaacccaggtggccattatgcaagttcaagtccaaaggccagacagcctggagttctgatggccaaggacaggagaaggagagtgtcagcgctctgggagagacaaaaaaagaatttgtcttctgccttttgttatctctgggacctcagcaaattggatcatgcctgcccacatgagggaggatcttcctcactcagtccaccaattcacaccccaatctcctctggaaagacccttgcagacacacccagaaataatttttaccaactctccaggtatttcttaatccagtcaagctgactccttaatttaaccatcacagcaactgggcaccaaaaacagattagtgatttacctccaggtcatgtggtcagtcaatggcaggaccagtaccaacccctaggttttccaatcctccatcgcatactttgcaccatcgttgctcagcacctactgagaagtggggacatggtaaagagctaaggatgcttgcaacccaatattcatgtcacttcttgaggtttcagcagctttttcatgcatgcattggctccatggtcacatacaagaaccctctgctttctcatctaagagtttcagagatgccaaagtaacaggattgaggctgaacaatcaccttcatttctaatgtttttcctcacaaaccaattcagaaattcagaaaacatcttactatagtagttgtttcctgaattactaaatggaagctttattaggaagtattctctgttctttctaccaaggcagctttgttccttgggcataaacaaaactatcccttctctctctaaattgaccacagagccaaccttatataaattagaacttgttagttttggcttcagatgccggctctttctcttgaggttttcacctacttaaaattcacttgttgccctttaaattcacatctagcttaaggcaaatgtttgaatttctaaaataaaaccatgtgcccaaaataagcttagggaaaaaataactgaaataaatggaaaattctccaaaataagcaaaagcattaaaatgataatgctttaactttctgaactaaactgaaaataatgtatgctcaagataagcttacaaccacggagagatctctcttctacaaagccttaaagaaaaagcaggaaattacctcagatgaaacttcattacatggcatttccattcccaggatccatcctcagacacgttgacttaattgctctggaaaagagccccagcatcaatatttttcaactttctaggtggttctaatgtcggtcacaatcaagaaatgacatgaacaatattctgaatcatttcagtagatgttgactgcatgactgtgctttctaccagtcctatcccacaccccgcctttttcctaaaataggtatgcatgcagtgtgtgctctgcacacatgcacatacacaaacacacacacagtttcattcatttgtatattcattcaatcaataagttgaattttgccttcgtgcaaggaaccatgactatcagcacaaacaagaaactattcctgaccccaagagattcccagtctaggtgtggagaatatgaagcacagaaatgggaacaactctaggtaggaaatggaaagagagcaaatttttttttttaagaggcagctgggcacagtggctcacacctgtaatcccagcactttgggatgctgaggcaggaggatcattggaggcaaaatcaagtgtacctaacagttttagaaaattgtacatcgtatacttccactttccatcgtgacttctgttcatagtttatagatgtacaacataaagacataattcctaaataaacaaagcttctgtgaaagcataatgtgactctgcaggcctgctggcctgtcttattattgatctgaaaacaagattgacactactgtgattattctttagtgggaagggacattcatacttatttagccattgctatgctttcaggcaaatcaacccctcagtaactccaggcaaatgaatataggcctttcataaaaagtgtcttggagagaaagcccacaactgcaattaacaggaaatagctgatgcagtgtgacagcaagtccccaaacccttaatggaaggattgactgtcatgtgcatggagatgtggttagagaggaaataagttactgggttttgtaaggcaccaacttgaaaaacatgaaaagctgtggcaggccacaaacatggagcccatttggagtagaggcaggcaagtagaacggagaaccgtggcatttcaaccctagattaatctgagtgtcgcttttgctgccactacttaacaagagtagctgtagagagtgaaacatttttcctaaaatgtcatattttctctggtagctcctgttttcttctttgtatcacattatagctccacaaagttcatgcaaatgcataactaaattttgattatgagaggtctcagaatgcaacttgtttatgggaagaatatcattagtatagtttcaggcaattccttgcaaactatccccagtttaaaacagtcacaccttagtcaacaagcatctattgagcaacccactttcgacctggcattatggtaggtgcaaaggctaaaaaaaggtagaatgagatagaacctccacggaatatatacaataacaaattatttttttaaaaaactggatataacttgagaaactcttctgtacaggcattctggagtgagctgcaatccatcattattcagaaatgcattcatgcattacacctttgtcaagccaagttccaggttctgtgcttggtgctgggaagattgaaaggtcagctgaagttacagaaggccacgatgccagcacagctgctgcctactctttcgcctgatttatttctgttatttcttttacaattgtgattaaaaaaacacataacaccaaattgacgatcttaaccatttttaagcacaagcagagtcacgttcagtgactccacttcagtcaagttcagtagcattaagtagagtcacgtttacgtgcatctggtctccacaactctttcatcttgcaaacccaaactctataccatgaagtatccaaagtactcatatgtatcaaaacagagagtaggtggttgccaggttgccagggcatggtggagggggaagggaggagttgttgcctgatttctttttaaagctcagtcttccctttggcttctggttctaagcgtgttagcatcacggccccttttcattatcctaaaggacagacccagccctggttctgcaggtgctgaattctacttgactccaaagaggctcagcctctacctgcacccaggttctgctaacttggtctaccctctgttgtttttcctctctgttttgttcccatttgtaagatctctgccaaacttacttatttgctgcttttcacagacactagaccataccacctcctgggtattcacgatccatgcctggcccagctgactgttctcttattccaggctgttcgctgtttacctcgtccctcttcagcatcctcaatatgcctgcataatgcatatccatttttctccccaaattaaaagctatggccactgtatgttgaaaaatgcttaaaaccccacctaaacattccaggaagcaggaagccatgaatgactttaaaccaagaacagtctcaaaaatgttgtggtttccagtatgtgagtctcggacttcagcatattgctgttcatatgccacacaaatgttctgtaaagtcccattgagaattatgtgcaaatttaaatgctctccagacaatttcaaatatcagctttgatgcaagacttcacctgctaaaagcatctctttatggtttgacactacatctctgacattttgacgtgatacatattccatcagcctgatacattgccacctcccagtgagtcacagtgtcactaactcagaattaaatatgttgctaaaccactttacagcccttgcaaagcacataaaggctgtttgacaattacccccaggaaggcaaataatcagtacacctctgattctcttattattaaccattataaaatcatgtgctgtgatcaaggtgtgtaacaaagacattgatttttataagactacccaggaagcaaatacatattcttgatatacgaaacacacaggaggcctcttcattttcctttgtgtctttaatttgctcagagctgctcctcatacagcactggctttcacctgtcaagctaaggctttaattactgagttatggaaaaatcattgccaattgccttaactacaataataaagaatatcttacaaaggataagaaatcttttttcttcggctctgtagttaaaagactagttctagttttaatctgaacttttctatttctctccctatatttccctttcttcctattttaattgctggttagataattaagtaggtacctgacctgcaccaaatgtgcttgggaaagtctctcgtattttcgttttgctttgttttgtttctgcatgccattgaaacccctgtgttaattattctttccttacttgaagtatcttatacaacctttcttcaccagtatccttttcactaggccaaatacttattttggagtctcaaggatgattttctaaatcttttcataaccgcttttagcccttactcagttttattgtgcctgcccctcattgcacaaagggatatatttgactattccatggcatatttgactttgtaattcgtaaattatttttcatgtcttacatggttaaagatacgtttcacttgagcttgtaacagacataaaaatgacccatggtaaacctgtcgtattagaaaatcaaacaaaaagcataaggagataacacggtaaaaatgaaaagagtacaagctttagacccgtgtggatccgagttcatatctaacttggccaactaatagcttgttaattatgttaccttaggttgtattttttttttttttttttctaatttagtctcggggtctccgtgttctagctccgacccaagggggttcccgggacgtggttgtggatgttcagtgtgcctttaactggatacttctttatcctggcagacggcctgatgcccaggtgtgacttgtggccaggtgtcccacaaacaggaaaacctgtttacactggcagatggccttgtggcgtgctatagtctgaatgtctctatcctcctaaaatccgtaaattgaaacctcattcctaacgtgatggtgttaataagtggggcctttgggagatgattaggtaatgagggcagagccttcatgaacaggattagtgcccagacaaaagaggcccaaggaagcttgtccacctttgtgccatgtgaggacactgctggaaggcaccatctatgaagcagagagtcggccctcatcagacaccaaatctactgctacctctgtctcgggcttcccagcctccagaactgtaagcaatctgctgttgttgttgtttacaaattacccagtctaagatattttttatggcagcccaaacagactgagacatggcttttgtctgctctgtgtctagtgtatgttttgttttggttcggttttaagtttgtttggtttttggtttttggtttcgctttgtttttgtagacaacatcttactatgttgcccagactggtcttaaactcctagactcaagcaatccttcgcctcagcctctcaaagtgctgagatgacaggcgggagccaccacgcccagccaccctgtgtctagcttattcctaccaagagaatcactctctgtgaaagctctgagcagaaggagagttaggttcgcgtgtgttgctcaggtgagacaaagaggagatcatacagcaaaacacatgaaataacagaagcagcgtttgactcacagatccagagcagagagggcagcctgcctctcagggccaacaggaaaggggagctgtcctggacacgcaggctccaccagtgtggggagcaaaagagatcacaagagacctcagggcctaagactttgttggggtctcaggagttacccaagcaggtttcctgctgagagttctaatgggggtgggtggtggggggcgttacagcaacaattaccagtttcatggagccacactgtgcctgagcggtagtaactgtggcatctccatgcagtccatgcagcgggaggggtcttgggcgtgagtcaggtaggttgtattgagctgtcccctggggaggtgggcactagcagatacctggattgaccgccttgaggagctaggaggaagcagagaactagaaatcatgtcaagattcactaagccctgcatctgctatgagaaagtccaacttacaatcaaaatggatgcccaggcaacataaaattgtaagatttcgctacgccttaggcaatgaaacttggctgccttccagtgaatatttactgagcgtctagcttatttgagaaaccataatagacactacagggactgcgaagaatgggaaataaaccaattacacaatcacccacatagcagcgatacaaggccagccatatcaaacaacccaacagataaacagttcatatgttatatggtgtcagaagtaagacacatcaaaaaatggtaaaatacgtttgatactactgtccttataaaatcaccaaccataggaaaaatgatttttattaatgacagggatataatgaaaatagtttatgtgtgaaaacacataagtaattacataatacattatgatcaaaattagatacagcattgctgggcaagacctttttctcctctaatgctgtccttcaatattattaccaaaatatagcaccagtttttgtttttgtttgaggcagggtctcactctgttgcccaggctggaatgcagtaatatgatcatggctcactgcagcctcaacctcctgggctcaagtagtcctcccatttcagccttccaaagtgctgggattacactcgtgagccattgtgcccagccagtacctggttcttaattaactatatgaaaggcaaaatctgttttgctgctgagcaattatagtactatgcattatgtgtgtgtgtgtatgagtgtgtgtataacatgtagtttatatccatatataaactacatatagtttatatttaattgagtgtagacaatttataggttataatatctttagttataacattcacatgggtgtaattttttatactattctaatttatcattcctttctgttttaccttcaactctggttgaagtaatgtagttactatctgttttccgagttagacttccacttttcctctctggctacctgacaccccaagctagtgtaggtggctatatcattgcctggaattgaagtttttaagcctctgataattcagtctgtagaagctacccagctcaagaacaaaggggaaattacatatttcataacatgcttcaacatgaatgcatttaattagtatttataaatttgaatcaaaatgcaggaaatattctaaaaatataatttctctagaagagttatataatctctattaatgtaggccaactgcttctgtttcaaacacagaagaatgttcttcaatttttcatttgtgaaactgaatagtctcttctgaaagagtatatagtatttttccttttgggaatacaaaagcttttacaaaatgattatactaatcatcagatataagagtagtaccaattctctacctagaatagctgttaaccatggcacttggtgaattgggaatagacttaaatgatgcttctccttgggcccccacctccccaactcctacctttctcgaaaccaggctatttctctccaaatctcctttccttttgattcttcagttcgtgctacatgataactacttgccattggtcattaattatggtcgacgctcattattcacaggagtatgacccataaaatcactgcaaacactgaataagttaatactgaaccattgcccctagagggaattcagggttaagttcctgcaagcctctggtcacagtatattcatcaacctatcaatacataacgttattttatgcatgtttctgctttaagacatcttacttaacatatgtttttgattcattaacactgaactcatggccaacagctctataactaatgtctgaaaaaagcttatctaataggcatgttttccccataaggcacatcacagccttcttgtgcttaggaacactggacgacactcaacactgcgcttgggggccatttgaaacagtaatatcaccaataaaaaaaaagcacaaaaatgtcagggggaaatgtggcagtaaataggctgtgaaaaagacatttgtttgcagtatgagctaaaagaaggcagggcatcaccttgttctacatcagtagggatcatgagtgttatgccactcaatttttttgccagcctgtgtgtacacgtgtcctcaaatgaccatgaaagcactgcaagtatagatttggggattacaaataaatttcaacaagtagatgagtttgcaaacatggaatccgcaaataattactgttgactacaccatccttttgaacaaaaataaaagccacaattcaacttgagattggttatagatggcaactggcatttagtgagcacctgctatgagctgggtgccttacttttttttttgttttgagacagagtctcgctttgtcgcccagtctggagtgcagtggcaccatctcagctcactgcaagctccacctcccaggttcacgccattctcctgcctcagcctccccagtagctgggactacaggtgcctgccaccatgcccagctaatttttttttttttttagtagagacggggtttcaccctgtgagccaggatggtctcaatctcctgacctcgtgatccgcccgcctcggcctcccaaagtgctgggattacaggcgtgagccaccacacccagccactgggtgccttacttttagtaacacattgacctgggatgtgatcaactcgagaaccacatcactgtcatgtagctgcatggagctgtatcactcaacttctgggggcttatgtttcataacaattatcttttataaatgttcaatttaaaaatgaaaaacttccccaccccaatcaccacctcctttccccctctcccttccctttaatgaaccatctaagggaaggacatgtgtgcttctttgacatttcttcacagaatccagtccaatggcagggaggctgggtgagggtcagtgtcagcctagccagtagggaatccatggagctggggcatgtcaggggagtgtctcttactgagaactctgggtcctcttggatcaaagaatgtgcaaattgagctaagagatagaggggaattcgagaagatcacctaaaatgggcaaacaggaggaagctagatccaggtagcctgggagtcaagaacagtgagccctgtgtgagctaaaaaaccagaagcaaaccttggccaatggctggagctggtgtttttgctcaagcctggctttcatgggctccccttgatgtgagtctcagagtagggctggttaagtggccaggacctgagaaataaaatctcccttatatactcttgagagaacaagtctaacatatcagtaaggtaatagctataaaaatgtggctaggccgggcgtggtggctcgtgcctgtaatcccagcactttgggaggccgaggctggtggatcacctgaggtctggagtttgagaccagactggccaacatggtgaaaccccatctctactaaaaatacaaaaaaaattagccaggtgtagtggtaggtgcctgtaatcccagctactcgggatcctgaggcagaagaatcacttgaacccaagaggcagaggttgcagagagctaagatcatgccattgcactgcagcctgggcgacaagagcaaaactccgtctcaaaaaatagaaaaaataagtggctaagtcagtagtgaaactacgaagctaacttattacatttttcaccttttgaactttcaaacttgagtcatttatggacatctttgaagggaacagttattataaactctcactgttgacctaattaacattataatgtcaattatatatgtatagaaagaattctagatatacactcctgctaatatatttctaagattttttaatgttttatgatatacaaatttggatataagaaaaattataaaaccaacaaaattaaaactagtaaagtgaatgtaacgagataggctgtatagttcacaccacacaatgtcgtttagtcgacagtggaccgcacagataacagcagttccataagattatagaggagctgaacatttcctatgcctagtaacatcacagctgttgttaaggtcctatcacaacacattactcctatgtttgtgatgacactggtgtaaacaaacctactgcactgccaggcatatagaagtgtagcttatacaattatgtacagtaatacttgataatgataatatttgactatgttactggtttatgtatttgctatattatattatacattttatcattcaagtgtattccttctacttattttaaaaaatttgctgtgaaacaggcagggtacagtggctcatgcctgtaatcccagcactttgggaggccgaggcaggtggatcacctgaggtcaggaggttgagaccagcctggttaacatgcagaagcctcatctccatgaaaaatacaaaaattagccaggcatagtggttcaccctatgatcccagctactcggaaggctgaggcagaagaatcacttgagcccgggaggcagtttgcagtaagccaagatcgcgccactgcactccagcctgggtgacagaacaagactctatctcaaacaaaccgaaacattaagtgtgaaacaacctcagcaggtccttcaggagggattccagaagaaggcattgttaccataggagctggcagctctgtgtgtgtcactgcccctgaagacctcgcagtaggacaaggtgtggaggtggaagacagtgatattgatattcctgaccctgttaggcctaggctaatgtgtgtgtttgtgtcttagtttttacaacaaatatttaaagtacaaaaatgaaaaaattcaaagtagaagaaaaggctgatagaataggatataaagaaaaaatatttttgtatggctgtacaatgtgcttgtgttttaagctgtgttatcacaaaagagtaaaaaagttaaaagaaattaaaagtttagaaagtaaaaaaagttacagtaaactaatgtgtattaaagaaaagtatttttttacaaatttagtgaagcctaagtatacagtattttttaagtcaacattagtgtacagtaatgttctaggccttcacgttcactctccactcactcactgactcacccacagcaacttccagtcctgcaagctccattcatgataagtgccctatacaggtgtgccattctttttatcttttactctgtatttttactgtactttttctatgtttagatatatttagatacacaaataccattgtgttacaactgtctacagtatttagtacaataacatgctgtacagatttgtagcctgggagcaacgggccatagcatatagcctaggtatgtagtaggctatacagtggcagtttgtgaagtgcattctgtgatgtttgcatgacaacaaaattgcctagagacacactcctcagaatacatctccatcgttcaggctcagcaatgcatgactgtattagtaaactaaatttccactttcaatgagaattttttcagtgtagcttgttttgagttcattttgcctatacactataagtttgtgataattcaattttgctactacttttttctaatcaaactactatcaaatctccacccacagagcatacttttatgtaatttgctttcacttgggccaaatatcatttttgtattaagttggcctatgttcttttctcaataggtaaccaaaattaaagcagtagcatttggcagcaattacaaacagaaatgagagcatttatgtcctggcgggagttggttgttaagtggccatccggaagttatgcaatatgttttctttctcttttcttttctgtttttttttttaagattgctattgaaatgaaaacagaaactgcaccaactgatgttaaagataaatacaaagccatcgtaattaaaagagtatgtcacaaatgcaagaataggcagaaggatcactggaactgattagaatgtcagaatactgtttacataagaagtagtgcatactgaaactggcaatttaaatgaacggggatcctgcagtgtaaaactctgaaataaacaaacaaataaataaacagggatgaagacaaattttgctaagaaaattatgtgactatactttaaaaaatagtttctattttacgttagatgctaaaatgaattccaaagaattacagacttcaatgtgcaaagaggaagaatgcatagaaaagtgatactaaaagcaattcagtatttttctgttctctaaattttaaaaagcccttgtggctgggcacagtggctcacgcctgtaatcccagcagtttgggaggccgaggcgggtggatcacgaggtcaggagatggagaccatcctggctaacacggtgaaaccctgtctctactaaaaatacaaaaaattagccgggcgtggtggcaggtgcctgtagtcccagctgctcgggaggctgaggcaggagaatggggtgaacccaggaggcggagcttgcagtgagctgagatcgcaccactgcactccagcctgggcgacagacagagccagactccgtctccaaaaaaaaaaaaaaaagcccttgtaagcataaatacaaaggaaacttggtagatatggcaacataacaattaaaagttcatgtaagtacaaaaatcaacaaattaaaaactgagaaactggaaaaatatttgcaatacattgatataaaaatcataatatgtttttaaaaacttttaaaaactagcaacaaaaagtaaaagatgaacaaccaggtgatggaaaaaaaaaaaaaagatccagaattgttcagtaaaggtgtaaaaagtgtttccaatcaaagaaatacaaactgaaacaagaatataatattttattttggttttggttttgtttaataagcagaaaatggtgaggcatttttgacaagcaattttgcaagacagatcaataatctttaaaacgtatgtagttcttgagcaaggattttcacctctaaaattatatttcaaagaaataattgtagaccacatgcaagattttttttacagattatttgtcataaagttatatataattgtgaaaaatgcaaatcaatgatatctgtcacccagaaaggaaggaaatggttaaatacatttaagtttagccgtataacagtattccttaaaaataagtctcctaggccaggcacagtggctcacgcctataacccagcactttgagaggccaaggtgagcggattacttgaggtcgggagtttgagaccaggctggccaatatggtgaaacctcatatctagtaaaaatacaaaaattagctgggcatagtggcgcacgcctgtagtcccagctactcgggaggctgagccaggagaatcgcttgaaaccaggaggcagaaatttcagtgagcctaaatcacgccactgcactctaggctgggtgacagagctagactccgtctcaaaaaaacaagaaacatcacctaaaaaaaagtctttgaagactattaacatggaagcatgataatggtataattttaataagaaattatgatagaacactgatagaatattatcccagttttacaattccacatgtatttacatgtacctgggaaaattataatgaaaatgttaacacatttttttcttgtcagtaagtgcaggggaaccttacattttctttatggttttctgattattccaaatattgtaaaatacacattattcatatacttttaaaatgtggatcttaactgttttcctttaatctgctatcttacctttttaaatctaggaaatgtatgtatctcaaaatggtaaaactgaatatttaatattctagaaattaatgttttataaatcttaattttcttctcagtaatattgtataattttaaatattggcagattgtcagctatggctgtgcctatttaaagccaaaactcctgccaattttgtgaaaacttacgctcattatctagatttttgtttgtagtacgataaatattttcaccgtactttacctgctttggcaaaagatagatggcagaagaaggagctgattaaataaccaataaatacaagagaaaatctgggacattttttgcttttattattactttttataccattatgctggtaaattatttataatattatgattatgctaggattatagaacgaaaggtaataagttttatggattgtcagtaataataattactgtaaattgtcttttaaaataatgaaggctaaaatacttaggtattgagagtgttttcttcttgctactctgtgatgtatcgttgcagcaggctgagataatggaaaaggctgagagctacaagccaaaaagactgggtgttgagtctctaattccacttcttttttttttttttttttcaagacagagtctagctctgtcgcccaggctggagtgcagtggtgtggtctcagctcactgcaaactctgcctcccgggttcacgccattctcctgcctcagcctccagagtagctgggactacaggtacccgccaccacacccggctaattttttgtatttttagtagagacagggtttcaccgtgttagccaggatgttcttgatctcctgacctcgtgatccacccgcctcggcctcccatagtgctgggattacaggcgtgagccactgcgcccggctaattccacttcttattagctctgggattgtggacaatttctctaggcagagcttcctcgtctgtaaaatatgaatgagtctaatatgtatgcatctagtaatctgatttaatcacaaaatgggactagactatacagtccttaaagaatctatcactatgacttctctcagtggcctttttttttttttttttttttttttacagagctggataataaagagcttagaattttattcctgaaaggcaactagagtgctaggcattctgggtttctgatagaagacatgcacataagctttagcaaacactcagaactctatgctccctaactacaacttcgccagagtgcagaggccaactcttttcctttaaaaaactaactccaggatgtgttcacatggtcaataagatctatagttctttgctgatcatcccctgggaaacttttaaaatgaagtctgacacattacaaaccatgcacagaaacaaacaatatcagtaaaactctcaagtaatgcgtggttttgagccatgtagagtccaggtaagccttccaagcttggttaggtgcaaaacatactttctccagtatgtaaattaataggaatctttttttttttttttttctgagatggagtctcactctgtcagccaggctggagtgtagtaccacaatctctgctcactgcaacctcttcctccctggttcaagcgattctcctgcctcagcctcccaagtagctgggattacaagtggacaccaccacgcctggctaatttttttgtatttttagtagagacgggttttaccatgttggccaggttggtctcaaactcctgacctcaggtgatctgcctgcctcggcctcccaaagtgctgggattataggtgtgagccaccatgcccagcctataaataggcatctttgatggccttttaaaacaaccagactttgtaggctatctgcaaaagataatagtttgaaattttaatatttatttaaatagtcctcctgatggtaactgatcactaacttttgaagtgcgttgggttggactcagtaaaaatctcagcaatagcttataggaaattattcttctgttttctaaggcaggaggctatgcacccgtgtcatctaaaagagtggcccatggtgctatggagcaagccaaatcttcattgcagtccagttctgtcatttaccaaatctgtgacctccagagagctgttttattaatctacccctcagcttcttcatctgtaaaatgggacaatgatagcccttctcttccagattaggcacctaatgcagaacctagtgagatctaaatatatattagctacatctattattatgtttataaagacaaaggataaatggtagtcctgttttgtcccactcaaagctgttctctgagccacaaaaagactgtttcagctgcatgccaagttaacacattgcagttaagaaggaaaagcattgcagttaagaaggaaaagcattgcagtagagactagtccgtgaacatctttgtcctcaccattcctatcgccttcttttaaatgaaggaggcagtgggtttcttatattttggtccccatgattttgcaatttatagccttgataacctggccacagctaattaagccaaggttcggggctcattccttaggccgtgatgtgcaacttggcctgtaccctctaacatggcttctcatgagaactctacctaacagaaagttctgtgttgaatagcgatgaacggattcactccaaccttctctcagtgactttgaataaaagatatgcagactgtatagcagcctaaagagtgggctctgttccctcgcaaattttagcatactcattgagaagggagggagctttggggagacagtgagagaagagaatttaaacattgtgggcaatttcttctgcccttccatttgctgtggaattttccagccattttatgttctgtggatttttcatgcttgatatggttggtttctgggatgtgtttcagtcaacattgacccaaaaaccatgcagtcagttttctgtctaaaagccaaagctgtaacctcactgatattgcagaaatgtttctatcactttctgacccctaaaagtgcatgtctcttagatcatagctttgctggtatcaagattacatttttaacagtataaaccttttacatatgcagtagcaattagaatgctctccccaagaggaggacattctctgaaatcccaagtaggagtgaacccagagtagcatagcatatctgctaacttgattccatctgtctttgttgcaacatgctcactgagcatatgcccctaaatgaatatgagatgaagacaggatctgtggtccctcccgcaacattgatggggtaagtttttttgctaggctgagtgtggttcaaatatttttgtacaatatatatcctaaacacaaacaactacttcgtctgttgcccacccaaaaatatgctgatctgttttgtgctgaagtatgatcgttcgtgttggcgtccttgagaagtaatgggataaggtacttgaagggcgatttaagagctttccagagcagcccttggcttttcttaattttccagttttgcaacaacttttagagcccaatcctcatgtaagctttggatccactggaattaaaagctcagactttatagacaaacagacctgggtttgaatcctatttccatcacttgcctttaggaaagttgctcaacttttctgagtcttcattttctcatctgtgcccaccctcttattgcagtgaggcttgagtggtattcacagccctcggtgcagtcacttccatacataagagccactgttgttgttaacatagtttagaagttaagagagtcacaggcgtcgtaaaccctcagatagtaccagtcatgaggaagcagaattcactaagcggtgggtaggagggtgcacaagtagccaggtatacaagtagccgggagctgctgagtgtcccaggtctccatgaggatcaatcgctcaatagcttggatagtctgcgtgtggataacacatcagcaaggaatagagacaacgccttaaaacagactttcagcatttctggtgtcgaaaggtcctaacatgaggtctcactaaattcgagatttcatcagcctgagaagaactcagggtaaaataagagtagtaatacacaccccttttaacctgggttagaatgcgtttatgagtgtgaggtgatcttcaagtataaagccctatgtggatgtaacatgatagcagattataaatattaatagcattttaagtcaaagataactatttagaattgtgaataatagagaagaaagactgtgggcatcactgtacctcctaccctcagttaaaacttactgaaggaactgaaggttaaacattcttgataaccattgtatttctgcagtgtctcagaagtattactagaagacaagcatgggatttagagttaaactaaccttgggttcaaatcataatgctgccactccttgactgtgtgatggtggagaagttatttcacttctctaagcttcaaattctctatcagaaatgttttttctgtagctatctgcttaggaacaaagagaaaggcagcttcctgcatgactcagcttccagcttattattattattattattattattattattattattgttattatttgcttttgacaaagtgaactgaggtcccaagtttttatttccctttcacagagtcaagtttattggtataatcctgctaagaagtacttaaaacaaaaactagctattcacaaacaagtcaaatatataccctctagagtgtgttgataacgtgacttagtacatgaagagagagcatggtgttcaattgtgcaggtcaggtgaagctagtctttcatgcctcatcacaagtagcagatttccattaagaattggcaagctctcaaagctcagactctcccagagcagagcaaacaggcagatgcgaatacatgcctatcccagcagcatctgtttatgccagtggggagaaaccatcccctccacacacggttaaacaagtcagtgtgcagcctacctccagggcccttctcgttttgcctgggaatgtcctgggtggcttgtaggagatgaggatgcagcttggggcagccaaacctggggcatttcagaggcagagtataattcatgtggcaatacctggctctttatggcccgtagttttacacctaccatcctctgcacacagaaaactttaggcagaaatggagcatgcacaaccaggtctgcatatccgagagtggtcatttccttgcaaggcgtgtcgcttgactgaggggactagggggctgcagaggggctggcagatgtttggcttttggtgcagatatgagccaaataaattgaaaataggaagaaggagtacatgacctcacccaaattttaattcccatagaatagttttttgtttgtttgtttttagcgttgtatgcctaatagggtaaatgttattcaaaaaatagcccaggtgttagaaagacaaaatagttgttacctttagggaaatggttgtgaacaaaaggggcacacagggggtgtctgggccactaataatgttctgtttcttgatgtggattcgagttacatgggtgtgtcactttatgaaaattcatcaagggccatcaagggctcggtggctcatgcctgtaatcccagcattttgggaggccaaggtaggcggatcacttgaggtcaggaattcgagaccaacctggccaatgtgatgaaacccaatctctaccaaaaaaataaaaaataaaaattagctgggcgtggtggtacactgctgtagtcccagctgcttgggaggctgaggtgggagaatcacttgaacccaagacgtggaggttgcagtaagtggagatcatgccactgaactccagcatgggtgacagagtgagaccccatctcaaaaagaaaacaaaaacaaaaggtctggcacggtggctcacacctataatcccagcacttttggaggctgagcagactaggatcacctgaggtcaggagttcgagaccagcctgaccaacatggtgaaaccccttctctactaaaaatacaaaattatccgggtgtggtggtgcatgcctgtaatcccagctactctggctgaggcaggaaaatcgcttgaacccgggagagggaggttgcagtgagctgagacggtgccccattgcactccagcctgggcagcaagagcaaaactctgtctcaaaaaaaaaaaaaaaaagaaagaaagaaagaaaattcatcatgctgtatacttataatctgagtatttttcttcatgtaggttattaaaaaacagcagaaatattcttctctcaaaagaaatttctatattttaaaatatgcatatttatactatacatatatttatatttaaattatatatatatatttagtaaggaggggaatacatataacttgatacaaagtctgcactaagttagaatatatctaatgcaaattaatacttgagtgcatattaagatatatcaaaatttaaaaattggtcaaggtttttaagtgctttgacagttacagtaaggtaaggttctacataaaataacatgagtattgtcagcttccaccttacatttccaggaatagtcatttttcatgcattcattatattcttttcagcatcatttgcagagtttttgaacttctaagctgtaccacacagaaatgccataacactcattttgactatttcaacaaagtattataactaagccattaattgatccactagctttgctgttgggaaaatttacttattttgtaaatacagccacattgacttttaaagtcatctaaataagcttgttattaaataaaaatgttttgaaccttaaaactgctttaaatgattttaaataaatggtttatatttttttctcagtagtaataatttttctgaagtatttgcttattgtttttaagtgatttctttatacatatatatgtatatttacatactatgtgtatatattaggcaatattaaatgacctgaagcttttgatcaattctaatagaacagacaattgcaattctaaattagctctcataaaatggaacattttgcaagtagctaataaatatttgttgatcaatagttataccttgaatcctttatctattagaattttccagacaacaaactcatattgtttctcctttaggttcatttggatgtatcaacatagtaactcttgttacaaaaatattttaagtttaaaatcaattatttggttaaattctgtatgcatattttaatagttaatagacaaggtaaaatcagctcacttccatgtgttcaatatttattgcttgaaaattaaggcttataaattagagtatgctaactatgcctttttgttatagatcctcagcgctgttggttgtattatggaatagttaagtataggctctgctctccagacaccaaaggtttaactcagctctgtctttcaccaggcttgagcaccaaaggggaagtcagagaaaaagtaacagcaagtgaaataaaaatagaattctcaaaagcaatagttgaaagacaagaccacagaatggtatgatcaaagtgttgagagaaagagaaacagaaattgagagtttgagaccaaaaggtttttcattaaagcaatctctaaaggatttacttaatttttttaaataaaagaaacccagaagaaatgtctgaggtgtaagaagtattgatcaaagacattaatgaagatataggttaaaggtttttaaaactgtgtaataaaatattaacatcaaaattaatgtgttttaaaaaggagtaaatgaaacaattaaaaatgaagtctgttagaaagagaataatcaaaattacagttttttaagatccttgtattttaagaggatttaaaagagtgattaactttagactttcttaagtatgtaagatagaattccaaagtgcccactttttaaattttttattatttattttttgagacagactgtcattctgtcacccatgctgtagtgcagtggcatgatcttggctcagtgcaacctccacctcccaggttcaagtgagtctcctgcctcagtttcccaagtagctgggactacaggtgcacgccatcacgcctggctaattttttgtatttttagtagagacgaggtttcaccatgtcggccaggcctatctcaaagtcctgatctcaagtgatccacctgcctcgccctcccaaaatactgtgattacaggtgtgagccaccacacccagccttcaaagtgcccacttaatattaaataatatataacttcaaaaccagaatgggggaggaaatggattaagaaaacaaatataaatcatctattcagaaagactaaacaatataagacaataggaacaagtctgtctttcttgcttttacatgtgtgcatgtgtgtgtgtagtctagatacctagatagttagataaatagatatagatagatagataaacagatatagatagatagatagatagatagatagatagataaacagatatagatagatagatagatagatagataaacagatatagatagatagatagatagatagatagatagatagatagatagatagatagatgatagagagagagagagagagtgtgtgtgtgtgtgtgtgtgtgtgtgtgtgtgtgtgtgtgtgtgtgtttagtccatggcagtggactaaatatactagctaaaagatcttgtcaaattagtttaaaaagaagctaagtggtttttttaagacacatctgaaataagaggactcagaaagcctgaatggaaaataatgaaaagagacataatatgcaaataataattaaaggaaaaaccgggtaactataatagcaggtaacaaagacttcaaaaacctttttagaaggtagaaaggatactgaattatggcaagcgattcattttgccagaagaacttagcaattttaaacttgaattcgcaaaatactctcaaaatatataaagcaaaaattgacagaagtgcagggagaaattgataactcaaatatcatagaagaaaatgtggcatattaatttcagaactgatcatttaggcacacgacaataagtaaaaatagaggtttccaccaatataatttaaaaacttgattgacataaagtctaaacaaaataaagaacacacattcttctaagatataaatgaaatgtttaaaacatttatgactttctaggggaaggtatcttaaaaatacttagaactgaaggacaataaataatcctataaataaatattcatgagatgcaagacaaagatagttgtagttattttacactttaaatgcttaagtaaaaaatgagttaaggctagaaactcatagctaaattcaaataaagtaaaagtatgtgatgatgtaagagcagagcttaatgaaataaaacttgaagttatagtagggaggatcaacatagtcacaagttagtttcttgaaaacagaaaatcctccagcaaaattggttaagaaaaaaggagaacaccacaaataatcaatacaagaaatgaaaatggagataattataggtagcagacactttaaatgacaataagagaataccatgaacaaagctggccaaagcatttgaaaatttaggcaaaatggatgaattccatctatagtatatatgtatcagaatattatttttattgaaagatattgtcactgggtatcgagttctaggttgacagttcattatttttttctttcttattttaaaggtgtggtcctactgtcttctggattgcattatttcctgtgagaaatctgtcattgatatgtttgctcctttatgggcaattgtgtcctttttctctggctgcttttaagaatggccttatgatatacctcagtgtagtttcttccattcatgttttaatttaaagccattatctcttcaaatattttcatcactctcccaacccccacttttggaaattcccattatacatattgtaccacttgactttgccccacagctcattggtgctctttccttttttcttttttcttttctagtagcttttttttcctctgttttttattttggatagtttctatcactgtcttcaagttatctaatcttttcttctgtagtgtctaatctgctgttagccctttccagatattttttctttttttaatttttttttttatttcagtaggtttttggggaacaggtagtgtttagttacatggaaaacttctgtagtgggtgacaacccactctttgggttgtctgtttactctgctgattacttcttttgaggtacagaagctttttagtttaattaggtctcatctatttatctttgtttttgttgcatttgcttttgggttcttggtcatgaagtctttgcctaagccaatgtctagaagggtttttctgatgttatcctctagaatttttaggatttcaggtcttagatttcagtcttcgatccatcttgagttaatttttatataaggtgagagatgaggattcagtttcattcctttgcatgttgcttgccaatcatcccagcaccatttgttgaaaagggtgtccttttcccactttatgtttttgtttgctttgtcgaagatcagttggctgtaagtatttgactttttttctgggttctctattctgttccattggtctgtatacctatttttataccagtaccatgccatttggttgactgtagccttatagtatagcttgaagtcacgtaatgtaatgcctccagatttgttatttttgcttagtcttgctttggccatgtgggctcttttttagttctgtatgaatttaggattttttttctagttctgtgaataatgatggtggtattttgatgggaattgcattgaatttatagattgcttttggcagtatggtcattttgacaatatttattctacctatccacaaggatgagatgtgtttccatttgtttgtgctatctatgatttctttcagtcctagccagagcaatcagataagagaaagaaataaagggcatcaaaatcagtaaagaggaagtcaaactgttgccgttcactaaggatatgattgtatacctagaaaaccctaaagactcatccaaaaaacctcctaaatctgataaatgaattcagcaaagtttcaggatacaaaattaacatacacaaatcagtagttctgctatacaccaactgcaagcaagctaagaatcagatcaagaactcagcctcttttataatagctgttaaaaaaaaaaaaaaaaaaaactcaagaatatacctaaccaaagaagtgaaagatctctacaaggaaaactacaaaacactactatcttttgtatttttgtttcagtttcattgagttttactccgatctttgttatttcttttcttctgctgggtttgggtttgctttgtacttgtttctctagttccttgaggttttaccttacattgtctgtttgggctctttcagactttttgatgtaagcatttaatgctatgaactttcctcttagcaccaactttgctgtatcccagaggttttgataggttgtgtcattattatcattcggttcgaagaattttttaatttccatcttgatttcattgttgaccaaatggtcattcaggaacaggttatttaatttccatgtatttgcatggttttgaggattccttttcaagttgatttccaattttattccactgtagtctgagaaagtacttgatataatttcaattttcttaaacttactgagacttgttttgtggcctatcatatggtctatcttggagaacgttccatgtgctgatgagtagaatgtctattctgtggttgttgggtggaatgttctgtaaatatctgttaagtccatttgttctaggatatagtttaagtccattgcttctttgttgactttctgtcttgatatccagtgctgtcagtggaatattgaagccccccaatattgttgtgttgttgtctatctcatttcttaggtctagtagtaattattgtccaaatttgggatccccagtgttaggtgcatatatatttaatattgtgatattttcctgttggactagtccttttatcattacataatgtacctcttcgtcttttttaactgatgttgctttaacatctgttttgtctgatatatgaatagctactcctgctcacttttggtgtccatttgcatggaatatctttttccactcctttaccttacatttatgtgagtccttatgttaggtgagtctcttgaagactgcagatacttggttgaattcttatccattctgcaattctgtgtcttttaagtggagcatttaagtcatttacattcaacattagtattgagacatgaggtactcttctatttatcatgctagttgttgcctgaataccttgttttttgtcaccgtgttattgtattgtatgccctgtgagatttatgctttaaggaggttctattttggtgtatttcaaggttttgtttcaagatttagagctccttgtagcaattcttgtagtgctggctttgtagtggtgaattatctcagcatttgtttgtctgtaaaagaccatctttctttcatttgtgaagcttagtttcactggatacaaaattcttggcttttaattattttgtttaaggaggctaaagatagggccccaatcctatctggcttgtagggtttctgccgagaaatctgctgttaatctgataggttttcctttacaggttacctgatgtttttgcctcacagctcgtaagattctttcctttgtcttgactttagataacctaatgactatgtgctaggtgatgatctttttgtgatgaatttcccaggtgttctttgagcttcttgtatttggatgtctagatctctaacaaggccagggaagttttcctcaattattttctcaagtaagttttccaaacatttagatttctcttcttccttgggaacaccagttattcttaggtttggtcatttaacataagctcaaacttctttgaggctttgttcattttttaaattcttttttctttttttctttttttttagtttgagatggagtctcactctttcgcccaggccggagtgcagtggtgctatctcggctcactgcaagctccacctcctggattcacgccattctcctgcctcagcctcccgagtagctgggactacaggcgcccaccaccacacccagctaatttttttgtatttttagtagagatggggtttcaccgtgttagccaggatggtctcgatctcctgacctcatgatccgcctgcctcaacctcccaaagtgctaggattacaggcgtgagccaccgcgcccagccttaaattcttttttctttgtctttgttggattgggttaattcaaaagcctcgtctttgatctctgaagttctttcttctacttgttccattgtactgaaactttccagcgtatttttcatttctctaagtgtgtctttcatttccagaagttttgattgtcttttatttatgttatgtatttctctagagatttttttgtccatatcctgtattattttttaaatttctttaagttggttttcacctttctctggtgcctccttgagtatcttaataatcaacctaccgaattatttttctggcaatttgaagatttcttattggtttgaacccattgctggcgagctagtgtgatcttttggggtgttaaagaaacttgctttgtcatattaccagaattgtttttctggttccttctcatttgggtagaccatttcagaggaaagagctggggtttaagtcctgctgttcattctttggtgccatggggtgatgccttgatgtggtgctctccccctttccctagggatggggctcactgagagctggactgcagtgattgttattgcttttctaggtctagccacccagtggagctactggactctgacctggtactggggagtatctgcaaagagtcctgtgacatgatctgtcttcaggtctctcagccatggatcccagcacttgctctggtcgaggtagtagggaagtgaggtagactgtgtgagggtctttagttgtagttttgtttagtgcatgggttttcttgaatgttggttgtgctagcagttagttggcctccagccaagaggtggcacttttaagagagcatcagctgaaacaagcttgtcctaagtttgcctgaataggtatttgggcttctcaggtgatgggttggaccatagcgctcccaagagattgtattttctgtcttcagctgccagggcaggtagggaaagaccactgggtggagccaggattaggcgtgtctgagctcagcctccccttgggcagggcttgctgcagccactttgaggatggcggtgtggttctcaggccaatggagttatgttcccagggggattatggctgctctgcagtgtcatataggtttccagggaagtgggggaaagtcgtcagtgactggcctcactcacttcccacacagccagcaaggccagtctcactcccactgcaccccaccgatagcactgagtttatatccaggtgccggtgagcagagctgaggtcttgtcccagactacaagcctcccagctgagaaagcaagcaggactttcaggccccacctctccccacctgctgtagcttctttgctcatatctacactttctgttcaccccctaccccacccctgccccagattgtgcccagaaaaattcatatttggtcaaaattattacaaagttcagctagaagtttccttttccctgttgtctttccccagttccactggcagccctccccaagaacctctatgaggtaaagtcagaaacggcttccctgggcaccaggaatgcctacagggctctttctgctgcttcttctagttttatatttcactgggctctctaaattcatttcagctctaggtaaggttaaattcttctcctgtgatctgaatttacatgttccccagtgagggtatgtgttcagaagtggactttccctcctcacgctttgggcactcacagtgtgaatttcactttgttgagtgtagatatttttatatcctatattatgcttaagctttgttctgggatgaaattaacttattgaaaacagttgatcctttggagacttgcttttagacttcatgaggtgagaccagcacagcccttttctagggctgattttttcccaataatgttataatttccttttgagtactgtacctaataccctgagttacaaggttttgcactcagactggtgggaacatgaattattcttaatctgtgtgagtaggttgttccctcagctcctttcaggtgagttttctctgacccaggttgttttattacacacatgaatttattggtaccttgctgaagacttaagggacacttctgcagatcacttaagttttctctctgtacagctctctcctgtctggtattctgttctgaagaccctagactaccaactctgtctcctcaagtaaggagctcaccaggttcctaagtttcccttccctgcactgagacccagaaaattttatcaggcagtaggctgaagcaattgtggggttcacattgtttgtgtctgtctctcagacataactgccctgccctgcctgatctctatgactgttttatatattttgtccagtcttttagttgtttcagacaagagtaagtcaaatcctgctactccttctcggctggaagtagaagtttctagtcttatgatttttaactgttgtcagctaattaaaatgtaaagttttataaggacttcataagtgtatgcaaatgctcctaaggctttcctggatgtcagtttaggcccccaggcttcaggattaatctttaattaatactctgagtggagacagggaaaagaagggtgaatgaagtttctgtggtctaagaaatcccaatagacaacttctggagaaatgacaagagagggacataagcaatcaaaaagaagggcgaggccgggcacggtggctcacacctgtaattccagcactttgggaggccgaggcaggcggatcacgaggtcaggagattgagaccatcttggctaacacggtgaaaccccgtctctactaaaaacacaaaattagccgggcatggtggcgggcgcctgtagtcccagctactcgggaggctgagacaggagaatggcgtgaacctgggaggcagagcttgcagtgagccaagattgcgccactgcactccagcctgggtgacagacaaagactccgtctcaaaaaaaaaaaaaaaaagaaagaaagaaagaatggggaggggacatatgcatctccatctcaactctctaaaactaagactcagacagagattttggtgaaaaatgtgtgcctaataaaatacttgctctaaaaattagattctagatattatctgaatatgtgccagtcactattctaagcattttacatatgtggatgtatttaattctctgacaactgcataagtaagctattatcatctccagtttatggataaagaagcaggctaagcaaattccccaagatcccatagttaaaaaatggcatggctcagatttcaatccaggctctgtaactaatatattatctgctaagaatatcagtcttatcatgtttagttctctggcttaaagtccacaacataataaaagtgaattgtagatgctgagatgaagatattaaatgtaaatacaacaaatacaaggaaaaataaaaactgacaatttgtttaaaagggcaaggacatagaatcctctgaaatagacattgcactgagaagtctatcactagcatattaaggaatgaagactcagataatgaacttgctgttaaaaaagcaaacctctgttaataacttttaattaaacctttgattatatttttaaatgttttttatttcttaaaaaacagttttgggctgggcaccgtggctcatgcctgtaatcccagcactcgggaggccgaggcaggtggatcacctgaggtcaggagtttgagaccagcctggccaatatggcaaaaccctgtttctactaaaaatacaaaaattagccaggcatggtggtgcacacctggtagtcccagctacttgggaggctgaggcagaagaattgcttgaacccaggaggcaaaggttgcagtgagccgagatcacaccactgcactccagcctgggtgacagagcgagactccttctaaaataaataaattaattaattaaattaaataagaaacagttttgcatttgaataattctgacaccaaaataatttttatcctggaatacactattcaatagtggtaaactttgttatatggaaaacatttcttatttctgagcaatatcaggtaaatgaatcaggaattatttgaattagaaggtattgttactaaccccctcatacctccaatgtactaaaactaatacatcttaaaattccttttaatcatttaatttttcttttttccaaaattttccccacataaataaagtagaatttagcctcttctacttcaaaaataaagtattttctaacaatgtttatcattataagtttctcagggctcaaatgtagaacatctttttgatagcttttcactctttccccaaacatatcccagttttatgagaccaagtacaaatatcttcctgtcacacatcatcaggagaatcttgccaggtgcagtggctcacgcctgtaatcccagcactttcagaggccgagacgggcggattgcctgaggtcaggagttcgagaccagtctggccaacatggtgagaccccgtctctactaaaaatacaaaaaaaaattgctgggcatagcagcaggtgcatgtaatcccagctactctggaggctgaggcaggggaattgcttgaaccaggaggtggaggttgcagtgagccaagattgtgccactgcactccagcctgggtgacagagcgagactccatctcacacacacacacacatacacacacaaaatatggataaaatatctagtgtgagaggaacagcagaaggagaaagtaatgtcttgaggaaggtgcgaatcatctgtaaatactttttagagtaatggaattcctagacagacagcttcgcaggcagtattgccattcagtatcattggcaaccttcctaaaaggaaaagagtaatgttaatgccatttctgaaggtatgaattgaggattttgattctttttccataaatacttaccttgtgaaaactcctctgcaatctctactgtcagtaagttttataaatgctgtatacaagtcttcaattcaccattgcctgcttgaggcttatttattttttgagaaagaagctggagaagtcatttgaaaattcatgggtagttcactcttcaaggttgtggtgtgctcttcaaatagctataaaaatttccaagagacaggaccactgaccctgcgcttcgtagcaaatagctttacttactcattatctgactagcgtattagttaatcatgtaaacaattatctttcttttcaggtggcaataattcatggcatctcctcccccttccaccccacacatatacttatttattgtcacagcctgatttataattgttttttaggatttcttcatatcctccctcctacctttacccctgagttcagaaaataataaacactctaaatctccaagcaatggaactcttctaagagttaagctaaagtctatcctaccaccttgctatattaatgtcagctcatttgatgtgtctgtagagcaggatttgtttggcaagctttttctgtaaaggaccagatagtatttcaggctttttgagccatgtggtgtcggtcacaacttttcaactctgccatcatattgtgagagcagaagtagacaaggtatgtttaaaaaaaaatgggtatggttgtgctccaataaaatcttttttatagacactaaaaacttgaatttcatgcaaattttatgtgtaaggaaataattttttaaaaatctcttctttaaccttttaaaaagacaaaagccattcttagcctgtgggtcgcacaaaaacaggcagcaggccatgggccatagtttgccaacccattatctaaacggttaacagaatgcttactacaggttttctgaccctcagcactagtaatactttgggacagataattctttgttgtggactgtcttttgtttttgttttgagacagcatctcactctgtagcccagactggagtgcagtagtgcgatcttggctcgctgcaacctccacctcccaggttcaagcgattctcctgcctcagcctccccagtagctgggattacaggtacccaccaccatacctggctaatttttgtatttttagtagagatggggttttgccatattggccaggcttgtctcagactcctgacctcaggtgatctgcccgcctcggccccccaaagtactgggattacaggtgtgagccaccgtgcctggcctgtcttttgtattttaagatgtgtcatatcatctctggcctctgcctactaaatgccattaacaccctacatcccccaattgcaacaactagaaaatctacagacattgacaaatgacctttggggacaaaattgcccccagttgaaaatcactggtctaatacactgaaaacttagaatacaccgcataaaatatgagctggtaggctgcgtagtataagatagcgtcatgtgtcacctgagagatagccattggattctcatgcttctaatgtagaaaccataataccgtggtcttccccttacctacagtttcattttctgtggtttcagttaccagagatcaaccaaagtctaaaaatattaaatggaaaatttgaaaaataattcatcagttttaaattgtgtgctcttccaagtagtatgatgaaatcttacaccatcccaccagagacttgaaccagccatttgtccagcatatccacgcggtagctgctacctgttcctgagtcacttagtagacttctggattattggctcaacagtagaggtattgcagtgcttccattcaaaaattccttactttacttttattatggtatattattgtaattgttctatcttattagttactgctgttaatattctattgtgcctcatttataaattaaactttacatagatgtgtatgtattggaaaaaaatatggtacagctgacccttgaacaacacagatttgatctgtgtagtcttcttttatgtgttttttttttcaataaatacagcaggccctccatatcaatgggttctgaacctgcaaccaaggcaagacacaaatatagtattcacaagatttgaaacccatgtatatagagagctgactgacttttcatctgggagggttctggatggctcacttccatacttgaatgtgctcggattttggtatagaagggggtcctggaaccaatcccccatagatagcgagagatgacggtatacatagggtccagtattatctgaagtttcagacattcactggggctctgggaatgtataacctgcacataaaagagaatttccgtactacctccaagttaataaccactgaagaaatcctaggcttaagagagcccgttattggaacttagatggtggcgttagagtgcttatgctttggacttaggagtcagtatcccttccccccagctttgtctctttctatattcctttcccatttttcctctttccacctccttacactcaaaccatacagtgtgcacctgacagtggactacaaagattaatattcgatgaaaggactttgtccatttgaccagaccacttgaatgatgaggtgggagccacagaatacatagttgatattaaattaagaatctaggccagacccggtggctcacacctgtaatcccagcactttgggaggccgaggcgggttgatcacttgaggtcaggagttcaagaccagcctggccaacatggtgaaacccgtctctactaaaaatacaaaaattgctgggcgtggtggcaggtgcctgtaatcccagctacttgggagtctgatgcaggcgaatcgcttgaactcggaggtggaggttgcagtgagccgagattgcgccactgcactccagccggggcaaaagagcaagactgtctcaaaaaaaaaaaaaattgagaatctaaattaatttatagaaatcctttttccataaatttatcttttctccaagttttcttctgatatgcaaagtgtgagacacctactcttagcttttagatagtttacaggccaatgacacacagtagatgatgttctgccatgatgtctcaaaggcagagaaacattcttatttttatcaacactttctcatccccatctttaaattattggtataaacaaacttctgcttctcactttagattataattttatcattttttacaattcatcaaagaaagtttttctaaattgcacggaaagttctatagaatgctgagttatgtattctaaagaatatttctccttcccattttttcatagctaaactgtcaatatttttaccttaacttcctacaaagtcctatagctatttgattacttgatgtttcagtataaaaaaaaattaggtcaggtgtggtggctcatgcctgtcatcccagcactttgggaggccaaggcaggtggatcacctgacgttaggagttcaagatcagcctggccaacatggtgaaaccccgtctctactaaaattacaaaaattagccaagcctggtggcaggcactggtaatcccagctcctcagatggctgaggcaagagaatcgcttgaacccgggagacagagattgcagtgagctgagatcgtgccactgcactccagcctgggtgacacagcaaaacttaatctcaaaaaaaaaaaaaattaataatgctgcttctgcctgaaatacatgatttccagtgagtgaaggaccacttgctctactgaagtaaagctactttactcaagtctctgaaggagtaagagagtcctgcagggcacatttgaacagctcactttcagatacaagtgataaaaaatggagcctcagcaacaacaacaaaaattataacttttaaagagatagaacaacatggtttgaaaaggaatctggatttttgcctctggttgctgtcattgacagggaaagtcttatattttctgaacttgtttttaaatccccccaaatagagggattagactgtgtaattccacaaatccgttgattttatgacctggctatagcttgggaaagcaaccacatagtaccgttgttacactccagagctattcaaatattgttatcaaagtggtgccaaaaatttctaatcaaatatttggaagagtttggtgatgagtcgaaagtagcctgtatgtctctgaattctgtgatgtttctcatttttcctccccgtacagtcttcataggtatttagacaagtaaacacctgtaaaggaagaatgtgggcaataagaatgaatataaatgataaatcacataatctgatgtaatgaaagacttaagttattacagaaaacctagaattaaatgaaatatttaaaaagtgatgtcttcaggaagtctacagttcagattcaagggtggcaaatactgtccatggagaccagtagttctcaggagggtgactttttttctccaggagacatttggcaatgactggagatatttttacttgggcatgttgttgatatctagagagtagaggccacggatgctgctgaacacctccaatgtgtaggacaatgccccgcaacaaagaatgatctcgcccaaaatgtcaagaatgccaaaatggagacaccctggtgtagacctatgatagctctgacttctttttttttttttttttttttttttttttttgagacagagtctcactctttcacccaggctggagtgcagtggcccgatctcggctcactgcaggctcgatctcccaggttcatgccattctcctgcctcagcctcccgagcagctgggactacaggagcccgccaccatgcccggctaattttttgtatttttagtacagacggggtttcaccgtgttagccaggatggtctcgatctcctgacctcgtgatccacccatctctgcctcccaaagtgctggagtgctgggattacaggtgtgagccaccgtgcccggccgatagctctgacttctaagtcaactgtgttcatcagtttcatatctcccctcttactttccaccatcacaaaagcctctgcctcctaccaaatgttagtaaatgcagtgaatgttagcaatctatttgaaacaaggtttcttggcattcatctagctgtatggataaagttttaccagcacaaactctgtatgcatggggtagactggatcagacagagcaatctgaaccacaatgttggatttccttcaagcttgagaaatattaatactaccatatatacaggcggggcatggtgggtcacgtctgtaatcccagcactttgggaggccaaggcgggtggctcacctgaggtcgggagttcgatactagcctgaccaacatggagaaaccccttctctactaaaaatacaaaattagccaggtgtgggggtacatgcctgtaatcccagctactcaggaggctgaggcaggagaatcgcttgaacctgggaggtggattttgtggtgagccgagatcacgccattgcactccagcctgggcaacacagcaagacttcatctcaaaaaaaaaaaaaattaccacacatactaacaatatgaaagttctaattcatatttaaggaaacatctgcttctacatgtgtttctatctgtggttctgaaaagcaaatcctaatttttatgaatgataatttctgggcctctttttgtctttccccagatgttccctgctttgttgcttaagagctgcatggcacagaccataaaggttgtgagctcttcccatttcaagaaaccctggggagattcaaataaacaaattcaaaatgccccttagagtctttaacagaccagaattagtacgttgtttgtttgaaaatctttctttttttcggatataaaactatacactcaagactaaatggaggcagtacaattacacattttgactgaattgtctcatcagtaaaagtatcacctggctaattgtaactctttagaattggcctaaactagaaaataaacaaggaccttattcaagtatttcctattatgttacatacatacaagttaccaattagaagttgatatacactattttgtttaaaaataaaattcagcaagcttctgatgatttattctgttcttgtttttcttaccagttttactgccaaaataaactccttctcatacaaagtctgggattataccacagagttactataattggattcaactttaatagaatattacaatattaattttaatagagtatggtttcagatattaaaaagattaatgtacccaaaaacataatcattgttttgttttttttttagacagaatcttgctctgtcacccaggctggagtgcagtggtgtgatctcagctcactgcaacctccacctcctgggttcaagcgattctcatgcctcagcctctcaagtagctgggattacaggtgcatgccagcatgccaggctcatttttgtatttttagtagagatggcattttgccatgttggccaggcttgtctcaaacttctggcatcaagtgatctgcctgccttgaccttccaaagttctgcgattacaggcgttgagcaaggcattgagccaccccacctggccacttcttttaaattgcataattttcctgttctctatttcatccaatctaaaataataatgagttttaaatacttatttttaacattttttttacacctatgatttgagaatatatatatattaggccgagtttcatttttgttgcccaggctggagtgcaatggtgccatctcggctcactgcaacttccacctcccaggttcaaacgattctcctgcctcagcctcctgagtagttgggattacaggtgcccaccaccatgcccagctaatctttgtatttttagtagagacagggtttcaccatgttgtccaggctggtctctaacccctgacctcagatgatccaccagcctcggcctcctgaagtgctgggattataggcataagccatcatgcccagcctgagaatagatttttgacatttttaacttgattttccgagaagaaaaaattacatatttttaaaaataataaatacattgaaatctagattttaaaacatgtttactttctctcaaatttgttagaaatgtcacaacaaatagctttttcaacctatgaacagtatttgtagaagggaaaaatgaggaagaaatgggcacatttttctagtgattgaatggtggtgtctacatcttgaataattctcactgcatatcgttgcttgaattgtagatctgtatggcatgtgacttgcctgggtctatgatgttgtcaacagaaagagtcaaattctgtaaaatatttgaagagatttcttctgagccaaatatgagtgaccaatggtcccgggaaatcctgaaaacatgtgcccaaggtggtcgggctacagcttggttttatacattttagggggacataagacatcactcgatacatgtaagatatactttggttttgtctggaaaagcaggacaactggaagccaagggtagaagggggccttccaggtcataggcagattctcatgatgttgcccagatgtcctattgtaatttcaattggttgagtttatctaaagatctggaatccatagaagggagtgtctggattaagataagtggttgtagagaccaaggctcttattatacaaagcctacaggtagccggctttggagagaatagattgtaaatgtttcttatcagacttaaaaaggtgccagactcagtgaattctctcctggattagggaaaagacctggaaatggaaagggattctctacagaagttagatttttccccacaagagacagctttgcagggccatttcaaaaattgccaaagaaatatattttaagacaaaatacttggatttctttcaggacctgctatctgtcatgtaatgctatactagagtcaggctggatttgggtgtcttattgctacagaaagtcttaagatctctattaatgttaatgctggtcagctgtgcctggattccaaagggaggagggtataatgaggcatgtgcaacccccactccccatcatgacctgaactagtttttcaggttaactttggaatgcccttggctgagaggagaggccaattcagatggctgtggggcttaaaatgttatttttggcttatgatgtggaggcagaagtaacctgtatcactgttgtgccaaagtctctaagagctaatgtgcagttcaccaagttgtctccctatgagagtcagccatcactgcaaacagcaacactccaggttgattgtggttctgtcagcttcatcctgcaccccagagtaaagatgacatagtggggagcctgtcttacaatgagcatatagcagatgcaagaaataaacatttgccttgttaagccactaagatgtcagggttgtttgtcctgcagcaaagcccagctcatcctgactgataaacttatccattcaagtgatcagcttttggtgtaaatgcccctaagaaaactgataaagcggccgggcacggtggctcaagcctgtaatcccagcactttgggaggctgaggcaggcggatcacgaggtcaggagatcgagaccgtcctggctaacacggtgaagccccatctctactaaaaatacaacaaaattagcctggcgtggtggcggcgcctgtagtcccagctactcaggagactgaggcaggagaatggcataaacctgggagacagagcttgcagcgagccgagattgcaccactgcactccagcctgggcaacagagcaagactccatctcaaaaaaaaaaaaaaaaaaagaaaagaaaagaaaactgataaagcctgatgcactacctacctatgccttgccaaagaatggtaataatccaaaaactgtttaatttagaccttcactatgcaatgcatattttatctaggaacacttttactggtatcagtgatcaaaattatagagcagggggggaaatgtgaggaaacaaatctcaaatgtcaacatacgtggggatcttgtttgcagatgaggaagtgcattctcaaagctgtgtgaattgtcctcatcatacagctattttcattgtattctttcacaaaaatatgtatgtggatggattcttaggtgttagagacggggaggaaagaataaaggagactcaaggcataggtggaaaccgtgcatacagatggtatatctttatgtgttgagcatttatatcatgcatctgctaagtactgcaatggaaacaaggataagacgcacagacttccctaaagaaatgtaaaatctcaatgacaaagaaacatgtgaagaagttagtatcttaagcaaaatgatgcaattcatagtaggccactgtgtactggaaaagtaagggctattctattccaaagtgtgatttttttattgggtgagggggacctgagaaagcttcatggagggtgtgatagttaatactgagtgtcaacgtgattggattgaaggatgcaaagtattgatcttgggtgtgtatgtgagagtgttgccaaaggagattaacatttgagtccgtgggctgcaaaaggccgacccacccttaatctgggtgggcaccatctaatcggctgccagcacggctagaatataaagcaggcagaaaaaccttgaaaagactagactggcctagcctcccagcctacctctttctcccatgcttgatgcttcctgccctcaaacattggacccctggttcttcagttttgggattggactggctctctttgctcttcagcttgcggatggcctattgtaatcatgtgagttaatatttaataaatttccatatatatatctattttattagttctgtccctctagagaaccctgactaacagagaggagaggatatctgaactaagcctcagaggaggatgaatggcaaggagaagaaacatgtctccaggaaactgaggcctgagggggtagtaatttttcccgagcatatgataaatgacagtgatttgggaagacttcatggcatgaatgtatgtgagaaagtgggcttgcgagagcaagattggaggagttggttatggaaaggcgagtaaccagatataggctgatagatggagtaagcatagagaagggcattgttttgtttgcttgttttttttaattttttaaatgttttatagatatgggagtcttactacattgctcaggccggtcttgaacttctgggctcaagggattctcctgccttggcctcccaaagcactgggattacaggtgggagtcatcaggccggcttttaaagaagggcattgcagtaggaatagaatgaaaggaagagatgaatgaatggaagagatatatgagccatttcaaaataagaatcacaacagtggaactgagtggctgtggataaaagctaaaagggttaagtcagggttgggaccaacagaactagaacaatacttgtattttggcccagatgacaagggctgaagggcatccagtgaacacccagaaactgaggacgctagactgaagcccaggggaaaatccaagctagtgaggtttttctcttatgagttatgggaggagcaacttggagggaacacttattgattgcatctcttgtaatatccacagcaaaggcatatgaggcgaggctagggaaggagatagaggaggagtgtggtcagagacgcaaaaggcatcaaataaagctgatgtggaagagaaccaggacgctcattgtggtatgaaagtcaagagagagagcttcagggaggtgggggattcgcaggtttaaggagaaagcaaagagaatgaggaccaaggaaaggccattggatttgaagtttgagattttctttctttttttttgttttgtgacagagtctcactctgtcaccagcgtggagtgcaatggcaccatctcagcttattgcaacctccacctcctgcgttcaagcaattctcctgcctcagcctcccaaatagctgggactacaggtgtgtgccaccacgcccagctaatttttgtatttttagtagagatgaggtttcaccatgttggccaggctggtgtcgatctcttgacctcgtgatccacctgcctctgcctcccaaagtgctgagattacaggcgtgacccactgcacccggcctgaactttgggattctcttggtggttgtagagaatgcacttcattagctttagattctgggacagtcacattataaaagacaaggggaaataaagagggtatacaggacactggtgtatactgtccactccagatcagtggatgaagaggatctgcaccctaaggggacagcagatttatcccattgctttgttgtgttgctttgtcgagatgggagatacctgaaagcagaaggaaagcaacataggaagacgctcaaaaataatgattttcttaaatgcacatgataatttatggctgacactgacattttctcagttacctttcataataacattagagaaatgacataaggttgcagagtggggggcagtgggtttcttctgactccacttcggttcccttcatagcatgaacacatttgtaagggagaaaacgaggcaggaatgatgcacattccgagggtgggagtgaagaattaggagtcacaggtaggttagcatgtggaagagaaggtgactgaaaccagaggcagagaggagaaagtggactgagatttacatgttttactccctgaagagactagcagtccctatttccaccaagggcagaaacattcaaacattctgcatacctttccttttatgcatgaaataaaatactggcatttgaaggaagaggttgataatgtttatttcttagaacattcaagcttggcagttatgtgacttatctctagagcctctcagaagtctctggggacgcaggagtctttggagactcacactttctgcaaaagtgcagaaagaaatacaattacttaatgaatacctactgtgtactcagcaaatcctttatctgtcacttgtgttaatttctagaaattacataactaagagtctccatgaattgcacttgttttcttaagagggaaagagaaaaaaataccttctttccttaccatttaagccagtgctttttaaaccaggatctgacactccgtaggtgaccatagatgtagtatcacagatccgtctgtttccaaaatgttacattctgattttaagatcccctgaaagttgaaatttctcttttgctgcaacaactcacacttgagaaaaattttcacaggagactttattttcttaaagcagagtttgttaatatgaattctcacaggactgtggcaattcatttttcttttaatgcgttcattactctagaccaagacatcaatttttgtgcaaaccttgtttcctgctgccacctggtggaagccacataagagttttacagaggctttggtggtgctaggagaggggccagggctcttcctcagtcacagaatcccacacagtgatcaaagagcagatctttctattaaactccctggcagcaaaacagtagaggcttggctctctgccccgggactgtgcagaatgtcacaggtcggaagcccagagcatttttctcttcttttatctttagactcttgtggctctcagaccttgaatataattctttgctgaaaattctttaaaatcattatcttttctttcttccttttttctttctttcttttttctttcctcttttttgctatgctagacaggaagaaagaagggaatggcattttaatgtaaagaagattgcactgaaattatattacttgcttaattgtattaattcactgcaataacaatttaataatatgacaggtcatttacatgctaatcatttgggtctcttgtccagagaaatcatgaggaagggctgggaagtgctcttattatgatcaaaataatccacactctcctagaggagtgcataggtatagaactgacattgtttgtttaataaagtttcattcaaggcaatttggctggttcttttatcaagtgtaatgggaaaacaagccagtcctgatgttaaacactccaatgatccctcaagctttttattctgtaataagttttacagcattatgtgttacccacgacagtcatttagtcggtcaatttcaggctagtgataaaagtttgagtaatgggaaagctgtgttgatgttccatattctttgtgagatgtctatgaattaatgctcccaggtacacactcaatttatatttaacagccattactaaatgtaatatctaagtaaaacccagttatgacctatatatatggaaaactaattaaagctgttggaaacaacctatttccctttggattatttatgtaaatacatcgaggtctaaaaattcagtacaagtcagatgtgttcctgcctagggctattatataaagctcagaaaattttatgagaaaaatgatgattcttaaggattgagcttcaaatgtgaatttttctattttataaggatatagcttgggttgttaagcatcaacatagcttttcaaaatagttttttattctcacaagtttaaaggccttgtaaaatctcttctattaaatatacatatatacatacatattacatatacaccaattgactaacccctctaagtgctgtatctgaactaattttaaaagaatacccgtgtttttcagctcccaaattgaaaagattattagttagtaccgtgatttctgaacttttaatcaaattttcattcattttataattttgaaattttgacaatctgagaatcttctatgattaaatatattctttcttcctttcttttttctctttcccttccttccttccttccttccttccttccctccttccttcctgtcagtctgtcttgctctgttgcccaggctggagtgcagtggcatgaacatggcacacttcagcctcgaactcctgggtgatcctcccaccttggcctcccaagtgttgggatagcaggtgtgagccaccaagcctggccttataaccaattaaatgaaggaaatgatactatgacacagacaaccatttttcaatcaagttattctgccatattaaattttcagtcacctttctattgcatttattgaatttctactttttaccagttctaagcctagatctgtctctcttaaattattaaatgtcttattttcttatgaaacaaccttcagatgtaatacacagaagaaaaaggagtctcaggaagtttagtttgcccaactagaaattgagcacaattacttggtgtgttgagggggatttgaaactatgtccttatgataattgatagttatgataattgatgacaaaggggttttagaaagacctcttttgcttttagaaacacttctctttgcactttctttaatgcccattttttagttttatgaattaaataatatacatttatttaaacaaaagtatcaacatttctcaagtatctataggttacttatctactcaatgcaactaacaatcaaaaactagtgctccaacaaattaaattttccaaacactgaaatattgatcacaatgtctctaagcatttcattgaaataaaaattttgatgtatctaattttcctaaatattttaaatgcatttcaatatgcaaaactctcacaaaattgttgtaaatacaaaggtaatcagtatttttagattaaaatcagttataaatgtgctaatatagtgaatgtgacccttgtccggactcacatttttcttcttagtcttttcctgggttatattcttaacatatcagctatttttctatttttatagcttcttagggttcaaaaatattaccatatccaaatgaaaactaactacctgagagcagccaactgcaggatctgtgtcaggatccagctgattcttggtgaggacacagatccaggtgtctaaggagattcagacactagccagtcatcatcagattaagctgcacttaaatccacatatatcaaattgtttttttttatttttacaatggtgcgttactaccatgatgtcttcacaactgatttgagcagtgttgcaaatcccatttcattatcccatcgttgtgatatatagacttggcctgttggaataccttcttggaaatttaaaaaaatagtttattaagattattagggccattgaagaatttcctcctaggagataatgcattgagtctacctttcagtcctcctcctcagaacacgtgcccgaactatcatttttgagatcaccattgatttctttctacagcgtggtcactggtaccaataaaatgctagtcttcattcctatccagttattatgtggggccccatgttgttagtctttctgatttcattatgatactaagttttaagggaaacttgacttcctatttttgtgtctattgtactacccactatagcgactatatagtaaggaatataaatttgttttcataggaaataaaatacccacatatattaaatccccattaaacataccctatttcatttacccttctttaaattataactatctttttatatggcttatattaacttttctctctcaagcatcattttaagctaatgacctttcagactagacccaacttctttcagtcaaccataattcatgctcactttctccctctctctcatcaaatcatcgaaatttgatcagcaggaatctctttaacttgactccattgattttttagtgttttagtacagtctccaacattcttaaaaacatatttgttttctagcaataacaagatgtcccagactcattccaatttgttttgttttactgccccaaaacatggaatcagcttccctaccataagtagtaaagagtagtagagaatactattaaagtccaaaatctgggaactagggataaacaggagagttgatggtaagtaaaaccagtgctgctgcttaactatatttactaatgtcagagatggaaaatacaagttattttaatgtcataagctcacagtaattttttccaaataagattatatattgctatgctctacttttctcaaattatgtgattttattgaaaatgaaaacttttattttggaattgaaatatttgaccctcttctttctgcttaggggaattatttggaaagatttcttatgcctagttctgtagggttccaaaccatgtatactttcacaaaatgcatgtgtgcaatagcacacatgctatttccagcagcaagttgaatccttgtatctagcactgatggtcaatatgttttgcattttgctttcccacctccaatgaattagtataaactatgaccttcattgatatttctttagtttttatatttgtatgaatcagctacttcaaacccttaataaaatctacaacctctccaataaacccaaagttactagatggaaggaaacaaagattagagcagcaatcaatgaaatagaaacttaaaaacagaaaagatcaacaaaactacaagttggttttctggaaaaaaataaacaaaatcaataaaattttggctagactaagaaaaaaaaagagaagactcaaataaatgaaaccagaaatgaaagaggagacatcataacctataccacagaaatccaaaggatcacaagaaactgttatgaacaattacacagcacacattgaataagctaaaaaaagaataaattcttagtctcatagaacccaccaaaactgaatcatgatgaaacagaaaatctaaacaaaccattaatgagtgaggaaattaaatcaataaaaagcctcctatcaaagaaaatcccaagacctgatagctttactgctgaattctaccaaacatttaaaggataaaataccaattttttgcaaacttttaccaaaaaatgaagatgaagaaacattctcaaactcattttaccaggccagcattaccctgataacaaagccagaaaaagcaccacaagaaaaaaaattacatgcccatattcctaatgaatatagatgcaaaaaccctcaacaaaatactagcaaactgaattcaacagcatactaaaagaatcattcatcatggtcaggtgggatttatcccagagatgcaaggatggttcaatatacaataattaatatgatgcaccacattagcagaatgaaggacaaaacccatatgatcatctcaatagatgcagaaaagtcatttgacaaaatttaactttctttcatgaaacaaacactcagcaaattaggtacagaataaatgtatctcaacacaataaagagcacatacaacaagcccatagctgacatcatattcaattgagaaaagttgaaagctcttcctctaagattaggaagaagacaaggatgcccactcttgccatgtttattcaacatagtactagaagtactagccagaacagttaggcaagagaaagaaataaaggcatccaaattggaaaggaaaaagttaaattgtctctgtttgcagatgacatgatcttatatgtagtaaatcataaagactccatgaaaaaactgttagaactaaaaatgaattcactaaagttgtaggatacaaaatcaacatacaaaaatcaacagcatttctatatattaacatgaattatccaaaaaggaaataaagaaaacaatttcatttacaatactaaaaaagaaatacttaagaaaaatttaaccaaggaggtaaaagtttataatgaaatttataaaacattgaggaaagaaattgaagaacacaagtaagtggaaagatatcccattttcatgaatttgaagaatattgttaagaattcagtactacccaaagtgatctacagatttaacataatgcctataaaaattccaataacattttttacagcaataggaaaagtaatcctaaaattcgtatggaaccacaaaagaccctaaatagctaaagcaattttaagcaacagagagatatcacatgacctgattttaaaacctaccacaaagctatagtaataaaaacagcatagactagcataaatacagacacatataccaatggaacagaataaagaccccagaaataaattaatgcatttatggtaaataggtttttgacaaaggtgccaaaattatggggaaaggacagtctcttcaagaatgtatatccatacatagaagtgtgaaactaggctctcattttacaccatatacaaaaatcaattccaaatgaattaaagacttaaatgtgacacctgaaactgtaaagctactagaacaaaacatagggaaaatgctctatgatactggtctgggaaaagattttttggctatgaccccaaaagcacaagcagcaaaagccaaaatagacaaatggaatgacatcaaactaaaaagcttctgcacaacaaaggaaacaatccaacagactgaagagacaacctatggaatgagaggatgtattcacaaaccatacctctgataagggattagtgtccaaaaggtataaggaattcaaataattcagtagtaagaaaacaaataacttgatttaaaaatggacaaaggacctgagtagatgtttctcaaaagaaggcatacatgtgccaacaaatatatttaaaaggtttaatatcactaatcagggaaatgcaaattaaaaccataagataccacctcaaacctcttagaatggccattatcaaaatgataaaagacaacaagtgttggtgagaatgtgaagagggaaccattacacattgttggtagaaatgtaaattagtacaaccattagggtaaacagtatggaggttcctcaaaaaattaaaaatagagctaccatatgatccagcaatcccactattggctacatatccaaaggaaatgaaattagtatgtagaagagataagtgcactcctatgtttaccgcagcattattcacaatcgctaagatctggactcaagtgcccatcaacagatgaacaggtaaagaaaatatggtatatatacatgatggaagcttcaaaaagaaggaaatccagccatatggatgtacctggagaccattatgttacataaaataaactaggcacaaatcaagtatcctatgatcccacttacatgtggagggtaaaaaagttgaagtaattggaacaaagagtaaaatagtggttaccacagagactgggaggtggtgggattaggtagatcttagccaaaggacacaacatttcaattagacaaaaggagtaatttcaagagatctattgtacatcatagtgactacagctaatgacaacatattgtgtatatgaaaattgctatgagagtggattttatgtttccattacaaaaaaagataaatttttcagataacgcatgtgttaaatacctttatttagccattctacaatgtgtactgtgtatgtacatgtgtatatgtatataatctcaaaacatcatgttgtacaccatacatatatacaatttttacttgtcaatcaaatagtttttaatttttaaaaatttacaccttccttttggaataaatatcccagctctcaaagctgataagtaatgaagtaaggatgaagctacctgatttggctgatgtatggtccagagaaggcgatgcatatgggacaaaatcatgaattaaaaaggcaatttttctttagattaaaaaatgtcaacaaatagcaatgtttgttattctaaggaaaaattatttatgatacatgaaaacataaagaacatccaaagctgagaagtattctttcttcattctttttatagtcttcatcttaagtgacttcaatacataccatttatcagcatgtctgttacatcttatattgaactgtttccatggaacatctccatgggtcagactgtagcctcaaagatactacaagcaaaagagaatccagcagtgtagtgggagaaggaggaaaaccttccctgactgcttggaaattgatgtatttatgacatgaagaagttaaaagactaggccaagaggcacaggatccagataaaacaacttccctcgggttccagagacatgaaaataaagaatttatagttatcaggaaggaggtaatttgctgaaattcccatcacagatccaaaaacgaggaaggaggcagacatgtgttaatagctccgaagtggcctggaagtcttattttgccagtgatttaactgaagatcaaatacactcatgtaaggaaagcagagaaagcttgcataagtctctggcctggacctggaaacccagtctgctttatttccttgggggagcaggtttcctaattcttccacgacatttgttggttaaatgttgaccaacaaaagcagaatgttacattgtgtttgatgggaggggaaagtccttgttttctatctagtctggggaatcatacatcaatccacacaggaatatgcatcaagtgtttccatcttaatgagtggcatgattccagaagggcaacaggccaggagagctctaaagcttccctgaaaaaatggagaggctggttgtgttttgttcttgccttggatggatgaagaaatggaagcaggtgccccattgggaccatggatcaaatgcacttaggaacttaaaggaaagtctaggggctctgagtgaaccagcacctcctgccctgctgggggttagaggcttcactggctagtccgaagcctagtggttttgagtaagaaaagaacttcaaaacattttactgtgatttaaaaatcctccatggtgagcatgcccagcttttgttctctcgatgtacctccaatctctcaagaagacataatttagtaacgctggggttgctgctactataaatgctttgattaacattagaggaagaggacgacagaaagcagcttctgtcccagccaattaaagagcttgtttaaagtatgaaaatgatttattagacatgcaaagagggttgcaaagaagaaagacacacagtctcaatttaaaaaaaaaaaaaaaaaaaacaaccacaaagctttggtccaggtgcctgccttctgacaacacagataaacagtttagttgataatcccccacatcttcttcttcagcacagcaatttgttccagttatcatactttctaaatagaataaaagaaaatgatgctcctttataatatatatagggtttagataaaaataaatagcacagtccacatgctttaaaccaaagattgagtctgtgtgaacagaaataccagatagctgtttgatacagcatttcccaaatagatatatctgagagctctgctaaaaaaaaaaaaaattaaatttttttaaaaaggaaagctagaaaaaataataataaatagagccttgtgatcatatatgtgcatcaacaccggctatatactcctttcggaaaatcacaatgtacgtgactcttgcagtaaagaaatgtgtttaacatttttacatttttaatacagcatttctcatacatatttgactgtagaaaccttctctgatatgacgactattgtcattccctagaattagtattctgttcaacatacttggaaaatacttaactagccaatctatttacaatgggaagagctataaagtccctcagtcattaacagctaatacacttgaaagattgttagcagaaaaaggaaaacatgacgtcaggaagctggggccatggattttgtcccttacacataccttcgttttacagacatcacaatgacaaattcaccctgacccaactgaggtcacatcagcaactgaatgtaggtggattgtctgaaacccattaccgttgtccacccaccatcatagaaaattattttaaatgtatgtattatagtaagagtactcttgatagtattattttttctttctttcttttgagagagagtctcactctgtcacccaggctggggtgcagtggtacaatcacagctcactgcagcctcaacctcgcaggctcaacctcccaagatgctgtaactacaggccagtgccaccgtacctggctgattttttgtattttttgtagagacaggatttcgcaatgttgcccaggctggtctcaaactcctgagctcaagcgatctgcctgccttggcctcccaaagtgctgggattgcaggtgtaagccaccacacccagtggctaatattacttaaaccatataaaactaggcagtggagaaagggagtaagagtacaggctccagattcagacggactttctctgaagtccctcctactgcccatggggacttgaacaagttacttaatttctctataagcctcaatggcttcatctgcaaaggagaataatgacagcatctattttttaatgttttgtgaaacatatggaataatgcatagtaagtgcatagcacagtaaatgacacatattaaacatagacaaatattagctgtaatattttatcatcattttctttacaaataatagtgtttttggtaactaagactaagaagaaaagaaggaagacagaagttgaatgtccttgcagatggggggcaaatctgctggcaagatttgtgatgtgtgttgctaattatctgtgattaactggttaatagattagttaaatcatcctgttggctctgcggaggatgatctggaaggggtggtactagagtcagggagacaaaagcagtgggaaaagataacagaggatgactggagagactttggagctggaattgacagaatttggcacctgattttgcatgggcatgagatttctggcttagaagagaccctgaagtttcataatatggacggtgatattactaagatgaagaccacaagagaagccactcttggctgagcgcaatgagtttggttttagacttgctcttgcaagcttctggtaggaaatcttaatagttaagcacgttctgatagaattttggcacttggctctaggaaggaccctgattagacatagatggagctatcaatgggaagatagttgagatcacatagataaatgatacacagagagaagagcacagtggcatagtggagctcagaggaatgtaaatatttaagagataataagaggcagtggaaccaatgaaatgatgaaccgagagtaaagtagaaagatgatgagagagaataacgtcctgaaagttaaatgagcttgagtcaacaagcacagaaatcagggctacaggctacatgccaagcctctgaacttcctccgtcctggaccatggaccaagctcagtcctgttttccccagagacccacagaaacgccagtttgcctcctagtgtaaccctgcaaagaaagcaatgtcgttctgcatcaatgctgatgagcctgcgctgttcagtatctgtggggcttgccaagctactcctgctcatggaaacctcagtcaggagcgaggattccttggcagatcgtccctgtgttctctgcatgaggtctctgatctggctgcaccaataacaagaactaatgtcatgtttacccttcacaaagttcaaaataacggtacttcgaaattagccaggcttctaataagcagtctgagaagtacacagactccaaaacagtgtttgcagagcttctgtagaaaagatcatctgcatcagaggcagctgagatcctaatgaaaaagaactgcaagactgagtgattggaaatagctagggttatggctcagcaagctgccttttcagcaagccttgcagatgattctgatgctcaccaaagtttgtgagccactgatgactacagaaatagaatatcaggctgaaacacacaaaaagagcaccatcggggaaaaataatatgaagaaaatactacatttttagtcctggtccctaatccttcaaagagttgttatgctttgtggaaactaatcaggtctagtctcccacctttcaaattatttctgttaaaatgttctcccctcctgcccagaattttctaatacacagtggaatgctttattgctctctttaagcatgtcaactagagcaggagaaaagtttcccatgtattttcttcaaagaaaaagatgtttaaagtttaatattaaaagaaagagtcatgaagtagtttaacatttttttcacagggcgcagagagttgcttctgcatggttatttttactaagtactttccaatttatactttatttttctcaagtataaaaatggatcttcctacttaaaaacaccaatgtccaacttcatggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgagaagtaacaaccagctaattattataagtatagatataggccatggatattaaagtacccccattttgtgttgatacatgaaatcatagaaatttcatgtatcatagagattaatcacatagagattaatttagaccataaaaacatttcaattttcaggaatcccttattaaaataatttttgaaaaaacaggggtgaatattcatgaagccaccacgtcataaaggtttggttgatgaatagtgagagtaggggtgaatagaggtaaagcaggagacacattggcaaggtcagggctgcaagagacaggagagcatcgaaaccaaaccccaccttcccacactcctaaagactgtccagtgagtaattttcccatttatacaagagcctggtctatgaaggcaaataaaatggaaggatttaccctcactgggcattgaagcacaaaccttgcccaaggccctgtcccgagcaaaagagcttccctactgggaaagatcaagatcttaatatcccttaatataactcaaataatcattagccaacctgagagaagaggacaggctctgagtctgaggagaagggttggaagggtctggttagtgcctgaccttcctataatataaagctacttggagatattagagctagtgaatgccttctcccagccaaatccatgctccaggaatgggcacagagttgcaaactaaagatcaattgttcatcgtggtacatgtctttgtgaggtattatgggacaaacttcagttcatatgggaaaaccgaacccttcccacgtggtccgtgaaaacccagttgcacattttcagacaacttctttatgagtacagggcattaggaagttgaaccagcccggccaatttagaacaactggtctctttaacatgagcattccccgtcagtgctaccaaactcctttccatgtgtcccatgcaaccagaaaatgtgttgtttaaattcagctcgtgtcatttgtaaaaaaaaaaaaaaaaaaaaaaccataaaaaataaaaataaaaataaaaaaattaaatagtttgacaagataaatcagggactttggaataaagagttagtaatatgttgagtagtttgtcacatgatatcatttttaagctactcttttttgggggggcggggcacggagtcttgctctgtcgcccaggctggagtgcagtggcgcgatcttggctcactgcaagctctgcctcccgggttcacaccaatctcctgcctcagcctcctgagtagctggaagctactctttctaaataacttcaacaaatattactgatgtgataacaaggcttgatttcatcaagcagtaactctgtctccatgtggatagcggtcttttgaagccctcctcggctgttagagtgcataacccacagctctcaaactggtggagacaaggtggtatgtttgactaattcagtgacgttcggtaagcacctactatgtgcccagcaaggtgtcaaaaacagagcaaagaacaaaataggcaaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatgaggtcaggagatcgagaccatcctggcaaacatggtgaaaccccacctctactaaaaatacaaaaattagctgagtgtggtggcacacgcctgtagtcccagctactcgggaggctgaggcaggagaatcgcttgaatccaggaggcagaggttgctttgagccaagatcacgccactgcactccagcttggtgacagagcgagactctgtctcagaaaaaaaaaaaaaaaaaaaaaaaaagcatgcttgtgtgactggagcctaataagcaagtgagagaatagaattggatgatttcagaggcagagacaaaatataaggaggtcctagctgggcacagtggtgtgcatcatagttccagcaactcaggaggctgagcaaggaggatcacttgagcccaggagtttgagtccagcctaggtaagatagaccccatctctttaaaaaaattttttaaattttcattaaaataaatataaggtctttacgtgctatgtattccatgaagtccagagctatgaatgccatagagtaggttctcagtaaacatatgagacaaaatatggctgagggtgaccttagatcaggctttctgaatcttacagaaaaatcttcttttgaatctcttttagctgaactttgaagagaaggataaagtagcatctgtttcaggtgccagggaagcccagaataaaaggctcaggatgacacagccgcatcaacatccagtgtttattggccatctgtcccctaggaatgtcttaagagctcatgctctatttacgagaacagccggggacagtgagaggaaggaagaaattgctttataaaaaagagtagctgcattcttttgtgtgtggaaagagcactattgtggaagcgacgaaacccaggtgtgtaaaaatagaaccgagtgttcacattaaactttccgtgcctcagtttccccacatgaaaagtggacataataacagcacttgagtgagaattaattgagataaaacctgtgttgaaatactgcttagaacatgggaagggtctgagctactatttattaataatgccattatcatagattttagctacatttattaataactccatgaatttagaatgttaatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttctcctcaaaatcacagtccaataaacaaaagtaatgaaaagggtctaacttccgtttgtatctcatgaggagcatcaaaaaccagttagttcctagcatagcacacagcactcttgaattctttcagccattcccagggccctcgcttctctaccctgcccctcccatccctgtcaggtcctgagctcctccttgctcctccctccttttttttttttggttttttttttttttttttttttgagacggagtctcactctgtcacccagacttgagtgcaatgtcacagtcttgggtcactgcaacctctgcctcctgggtttaagcaattctctgcctcagccttctgaatagctgggattacagacatatgccaccatgcctggctaatttttgtatttttagtagagacggggtttcaccatcttggccaggctggtcttgaactccttccctcatgatccactcgcctcagcctcccaaagtgctgggattacaggtgtgagacaccgcgcccggccacgctcctccctcttttgaagacttgttggactcttgtctttccttctccttcctctttccttttccttttgttctgtctaaactcctacagaacaaataaatcaatgaacgaaacacctaggtccttcccagtgtgaatcctttccattaccatccacaaaggtgaccaccattaaagctgtgtgtgaaggcttctagacattagtcctttattctgagtttaagcaaatacacacacatacagatgcatgtatgcatatgcgtgtatgtgcatattatatatgtggggtatatacacatatctttgtatcaggcacataaacaatgcacacatacttaataggtttgtgcaaaaaaactgcaattacttttgcaccaacctaatattactataataaaatggagctgtgatatacattttattctgaaaatagcttgtcccttaacaacatacaatggacaatttacatagatcgattttatggtttatgccacattatgtcacattttttgtccaaatgaatgcatgtttcttcaaatacatacagtaataaatgtatacattgtggttacttccattttttgctatttgaaactctttataaacatttatatacccaaaggattataaatcatgctgctataaagacacatgcacacgtatgtttatagcggcactattcacaacagcaaagacttggaaccaacctaaatgtccaacaatgatagactggattaagaaaatgtggcacatatacaccatggaatactatgcagtcataaaaaatgaagagttcatgtcctttgtagggacatggatgaaactggaaaccatcattctcagcaaactattgcaaggactaaaaaccaaacaccaccgcatgttctcactcataggtgggaattgaacaatgagaacacatggacacaggaaagggaacatcacacaccggggactgttgtggggtggggggaggggggagggatagcattaggagtaatacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttcttgaaacaataaatccccataaacttcccataaagttctgcagaagtgaaatgtgagattggttcccttggaatccattcagtgctttgtttgtgcatcttccaatcttaattttagagcccttgttcttcgtccagagcccctagactgggaaaaggtcagaatgcaacatgtttcaaagctgctgtgctctgggtggctgtcagactgttggagagaattgctttcaaaacccagagtatgccaccatctactcagtttcagattagcgtaacccacagcaccatgctatggcaggggaagctataatctttgctttttgttatcatttaaattcacttttaaaaatattaagattctcaaacagccagattctgaacatgcagtcttccccattgctatcaattatgtctaaggcaaaaaaagaggaccaaaacttctattttttctaacttttattttaggttcaggggtacaggtgcaggtttgttatatagttaaactcgtgtgacggggggttgttgtacagattattttgtcacccaggtactaagcctaatacccaatagttattttttctgctcctctcccttcttccagcctccaccctcaagtaggcccctgggtctgttgtttccttctttgtgtccctgtgttctcatcatttaactcccacttataagtgagaacatgtggtatttgattttctgtgtcagtttgctggggatgatggccttcagccccatgcatgttccctcaaaagacatgatctcattcttttttatggctgcatagtattccatggtgtatatgtaccacattttctttatccagtctgctactgatggacatttaggttgattccatgtcattgctgttgtgaatagtcctgtgatgcacatttgtgtgcaggtgtctttataatacaaagatttctacgcctttggatatatacccagtaatgggattgctgggttgaatgcaaaacctcaattttacaacttgaaatattgaagcgggaaatgtaagtgaaatcccaaattggcatgccatactaaatgttattgtaataacttatttaatatttgattatccaagcacgtacttttgtaccacattctgctcaataaatgtagaaggaagtgccgccattttggattgcagcagtacctcttcgtgcagtgaaaatcttttatgttgtggcccagccagaccctcagtgcagtttgcatatagctttggggcctgtagtgctgtggtaaccattgttgaaccccaaatatccaagacaggtctcagtcaatttaggaagtttattttgccaaagttaaggttgcgggcccatgacacagcctcaggaggtcctgatgacatgtgcccaaggtggtcagggcatagcttggttttatacattttagggagacatgagacatcaatcaacatatgtaagatatacattggttctgtccagaaaggcaggacaactcgaaatggggagggggcttccaggtcataggtaggtaagagacaaatgcttgcattcttttgagtttctgattagcctttccaaaggaggcaaacaggtatgcgtttatctcagtgagcagaggagtgattttgagttgtgtctgtcctttgtccacaaggatattccttgtgagggaggtatgtagctttttttttttttttatcttagtagctatcgtttttaggaatacagtggaggcaggtttgccctaagcagtacccagcttgacttttccctttggcttagtaattttgggggtctcctttcacatcatccacgcagcagcaacttctggtgaacacactgttcattattccaggcaccacttatgcagtctgtctttccctgatacaaattctcagatttctttgaaattaaaactgttctaaatctgcatactggatattacttcattcacattatatttattttaattatgtaacacaaagttgtaaaacttctgttagtcttaatatagactcatatatgtcctgtgtcatcaatgtgaattccattttcaatcctcacctcaggatgattacgagcaaagcacagtgtgtctaagctccaatgcttcacactaaaaacagcaacaaaggccaccagttgcaaaacagaatcgttctcgctctcagatgtgttctttttatccttaaaatcagagcattcatttccgtttggatgcactatttatttttatatcagaaattattttcacttagcagttgaatggaatttgtttgcaggctttctttcaatagtatttccttcttcttgaggatatatgaattctaaggaaactgcagcacattttgtaaaaatccaaaccaattatctcacccctgcctacaaagaagtctttgttatttttctattattattaaaatatatcagcaagattttttggcctttatagttctttggtatttcaaaatgcttctgtatgatgttattgctttaaatcatcacaaaccctgtgaagaaagaattatttttctaatttacaaataaagaaactgaggtcttagaagactgaattcatttcctcgtctctctttctttgcactatgggttatcttgatgctttactgatcctgctctcccctgagacatgtggactctgttactgttttcagcaggaaaatcatggttctattaataggacatgtgaatctttttatttcctgtaatgaaaagagcacaaaaaggaaactttgatttgtgtaacgtaatcgtatggatcatatcaacccattaccctgggtatagagcagtttcccagtttcacatccgtcattctgctgaaatgggtggcttttttccacattttactcacctgatggatttgatataaaacctgtttttctatggatgtgaggctctggaggttttgtagtctatcaacacataaaggctgcctggcattacagcactcctgctctgcacagtggtggagtgtagctaaatgcagctcagtctttttacagctcagctatgaccatccttcattacaacagggcagatgataaaatggaaacttaatgctattagatcatgaattccaattatatgaagagagatggaggtaagagaaattagatgccaaaaggagatacaataaagacagaagtgacgttcacagggctggcagttctcagaaccattgtcacccatcattgtcagtaccacctgaggacccggtgaagatgactagcatatcagatatctgagaagggaaatgctgagtgtgtccaaacatccaaacaaataatgccaaacctagaaaagcttctgtccatatgggttaaatagctcttcaattctgaaactgtcaaaagtaggctttgcagatggtcatgtcaagcaatgataataactggtagtggaattcccatggttcaaatttattaaaaaaaacacactattttcatttattcaagaaacacatattgaatacctgtgtgtcaagctagatattacagttagaaatatatagaaagcacaatctctgctctctgaaatttgcagcctagcagaggagaggaacacatgaaagtaattataataacaagttagatgcaatgatagatacaagatatcctaggaggacagggaaatagtaccatgcccagtccggggatacgtcagaaagactgtctggaggaggtggcatctgaactgagtcttaaagaatgagtagaaatcaagtccaatgtggtatatgaactgagagagagaaggggaggatgttgtagaaaaagacaatccaaaaagaggaaacagtgcaaataaagctggaatccacacacaccattgtcatggtgggaacaatggtagctgcatgttgctgaaatatacattctgaggctaggagtagaaagagataaggctggcaaagcaggcctatgcttactatgccatgtcaccgagcttgcaatactatatattctgcaagctatttggaaccgttgggatttgatgcatgagagtgaaatggtcggttttgcattttattttattttttattttttttttttatttttttgtgatggagtcttgctctgttgcccaggctggagcgcaatggcacactcttggctcaccacaacctccacctcccaggttcaagtgattctcctgcctcatctcccaagtagctgggactacaggcacctgccaccacactcagctaatttttgtatttttagtagagacagggtttcaccatgttggccaggctcgtcttgaactcctgacctcaggtgatccacccacctcggcctcccaaagtgctgggattacaggcatgtgccaccatgcccggccttgttttgcattttagatggatttctctgttggctttatcaaggatgaatttgagatgagcagcagcaggaacagaaccaagttaggaggctgctgccacatccaggcaagagacaatgcagagccaaggcagcagaaggaatggagaggaggagacacagcacagactatttagaaggtgtggctatcaggccttggggattgactggatgctaaggaagggctcccaggttcctgccttgaatggcagagtgggaaaagctctaccttctgagatggagaatactgtggatatagttaatttggaagaaaaatgcttgctttcagatatttagagttagatctctactatgagtttaaggctaaaataggcatttcttactggacagctttaccttgatgatttatactgaagatctaacttatgcacaaatttgggaatcgttaacatatgattagtacttgaaatcatgaaatgggtgaaaattactcaggaaaagaaaaaaagcataaatattcatccctgggacacaggaacattttgaagttgtcattccccagagtcacccccacccccatggcacttcagtgtactgcacactttgagatatatatatatatatatatatatatacatatttttttttcctaataaatagagacgaggtctcactatgtcgcccaggctggtctcaaactcctgggctcaagcaatccaccggcttcagcctcccaaagtgctgggattatagacctgagccactatggccagcctgatagtctactccttaacctacaggaagcagacatcaatttgttttacaacctctacatgcaaaaaatactacatagtcttatttttactaaatcaaaactttgtttcttgctaaatcttcttcccctctttgccagggtgtaaaagattcagtcttgttattccccgctttctggaatcaatcacatagcaacctttagggcttacccaggacagaaattggagtgaggacaggaaggccacaagttcccatgacacacctagctattcacgtctccgcttctagttattaactttgagccccggtagacctaggattactcaggcataaataatagccccccaaatgaaaagtgggaaattgtagagccctaatgtggagagcctgaagagcttcataaaaaaatcttagacttgttcccaccctccaaacatgtgaaacacacaactgtttcaaacattttaaatgtaccgaaattacctcataagtaccctttatatttaaatgcactaataatgggattgacatgtaagaatttccatgactaggaacaagcccgttttaccacaagccccagaacctggctataggtcagctcacagcagtgcaggaagcacctcaactgctttcaccagcatattctttttctctgtgggaccccatccccattctagcccaaaggacccgaatcacagagacacacagggtgaaatatttatgttgttgactcctcccgcaaacttgtcctctgatcattttgtgttgcagccgtgaaacaggcttgctggacgggaagaaatgctgcagagagagtggctgactcaaacccatggacagcattttattaataacttgcagcccttcattctaagtgaagcttgcccaataaaatgaggcctagagctgaacaaagctcctcttacctaacctgaatgtacaaaaaaggtttaattaaggaagtaatttttttctcccgtaaggaaatcttgacaaatagactcaaatttgcatgcaaatgaagccatctggttgattgttgtccacagtccccagctcacaggaaacaatagaaggccctttgcataactcagagaatctgcaaatctctaacatttgggtcactaataattttcagagtaattagtctcttcagagctgctatttacattggaaggtgtttgccatttacagcagaagctatagatattcttctaggtgcagccccagtgtgagccatttggtgacctgaggaaatcactcaatctgggaggggaatgacaagaccattggccactggagccagcctggcagcgacactcctcaccaaactgcagcccagagtgccttcacgcagtcttctccatgcgagccaaacgcagactcttctagccaccatctcttcccccttcctaattccccatctcccctctggggagggaggagacagggcaggggcaggcacaccaggcagggcctctacttctcatcacctgtctctgctactctgcagttatctcccgtaaacatttgttcaaatgcaatcatgtccattgcttgggtaactctaccttcttagtcgtcaggtccctcctcctttcatcagatttttacttaatggctactctacaaagcgtaacacagggctggtgctcaaggatgatagctctgattcatgtgtcctgaatggaattaccaaaaaattaaaaaaaaaaaaatcagtggagatgaagagatagggagtacagagttttggaagctagtgagggagcagaggaaggaaagagatgacgaggacaaaagggcagacatgggtgaggttgagaggagtaaaccagctgaggaagtgaccgctgcaggcttagctgtcaatcctggggtttgctgctccccgtggttggaactggaggacataatgctctgtgaaataagccaggcaccgaaaacaaatactgcaagctctcatgcatgagtggaatctaaaacaacagactcagagaagcagagaggaagatggtgggtacagaggctggaaggtgcagggaatggggagatggtcaaagagtgcagttaggaggaacatgcttggttggttaagttgtattgcacagcttggtgaatgtagttagtaatagaatatgtatatttcacaattgctaaggatgaatttcaaatgttcttatcccccaaaatgttaagtatttgaggtgatggatatgttaagtaccttgatttaattatttcacttcatattcataaatcataacatcactttgtaccccatgaatttatacaattatacattgtcaatttatgatttctaaaaaagcattagtacctgtggtaaatcaggctcaggggaaaagcctcagggtttgtcgtcttactgttcacacattgaaggaaaagaggctcctcttccatctttccccattccttggccaagcccttgcacaggctgactgtaagtgaaattaaagaatatcagtgtagtagtaagtaatcacatttgttgatcttttgttttgtgcctagcactctgctaaatgtatttcatgggttatctcctgagattcttaccataccctataaaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgggtacagggagaacacctggaaattatcgccagatcaactcaaacttacaaagttttccagagcttacataccttgtaagctatatgtctatgagtaagtgtgcatttatctaaagacataagtgactcacttcttttaatttataactaagatctgagtcctgaagaccttcctctggagcctcagtaaatttacttaatctaaatgggttcagatgctggactaatgacccttgtctcctgctaaatcatggaggtttggggagttccttcagacccccattaaacttgtttgtggaggcctggggagtttcttcagacccccaatgaaacttgtttaatcctaaacaggtcctgttaagaattccttcattatcttgccatgtttcaaggtccagaaaaggcctaggcaaactctcggtgggcttttgttacatcctaacctttgtataagggcactgcttctttcagcttttaatatttaacttaaccattcagtcagtgctgaaacagttgttatggaggcctgcattagtaagacctggtctgccacaattccactgtacacatgaggatttaggaaggccaaatgatctgcctcacgttgcccagtaggtggagatggtagagccagaatgggaacctggaggtcggcttcctcagcctgcacacggaaacagtgcagggaagcttcaccaggtgacagcccagagcagcccagggactcacttcctgtcatcactcccaccccccaccacctcatcctggtagtaccacccgcgccaatgcttctagggctcttgctggacccacaggtggactgtgacttcagtctgttacctccttctcttcattctccacgaaagaacttcagcacatcacaagttcagttacttcactactggcagtaaaggaaaatctgtaagtccaggctgttgacaggcaggtgggaagcaagctgtggagctccaagaggcccaggaaccggaggcaggcaagggccgggctcagagccggaggaatggcggaacgtctatgtgagggtcagtcacaccccagctccccgctatgaccctgccagtgactgtcctactctacccatgcaggaagtgggggttcacactccagacaccaggcaccaaaaaatgggggtaaagctccttaataaaaacagaggaaattgacttaataaggttgacccctctccttagccttcttcctgtcagcttcccaagcactgagcaacagacatatattcctcatgaggaaagtagcggattcttctctcaagatattgaacattcagtgaccaaaacaagtcacagatactgacattcggagtcccttcaatgggacaggggactctccatgtgatcatgaagcccaaacatcaaatccaccaccatcccagacacacacactccagattgcagtcagctgtctagtacttgactgttcggtataaacagacaggtgagagtcaccaactatgtaggataatgtcagagatgtcataaaagaagggacccccaaactcacaatccagggtaggggtgggtggcaggaggtctgggaagaaacagaggcgacagagaaagcagaagaaaacttttgataattaaattaatattctcagagagacaagagaagatattgagatattgcctccaaaaaaattagaatggggtgctatgaaaaaggggactatcagagaacgagaaataatacttggaaatttaaaatatgatagctgaaattaaaacacaatgacagtattgaaaataaagctgaggaaatttccaaagaagtagaacacaaaggaaaaagatcaaaatgtggaacaaaattagaaaaaaaaaaatctaaaataaataggtgtttgagaaaagggatcagagaaattattaaagtctcagacctcatatgggagaaaaatctatatcaaggcaatcatgaagttccaattaaaagagttaaagaaaagatcctgaaagtttccagaaaggaaaaaaatgtaggttgcatataaggcttcgtaaacagaaagcagttgctttcccggtagcagccctgacagcctgacaattttctttctggagtttctcaattaagtgcgaaagtagaataatgactcatcagaggaacatgggtttagaaagttaacctcgagtatctcttttctcaaggagctacctgagaatgtgtttcaggaaaatgagagtgtagacctaggaagtggatgtcatgagatcctgaaacttggggatgtaataccaaagtgtggcaaaaggaagtccctgcactaatggcagagggaggtcccaggacaagggctgtgcaggaaccctgagaagaccccgtccaggtgggaacagaggaaagagagccatagaagatgcctccaggggacaaaaacgtgactgcagatggcctgatgtgtgcaatgttggaaaatgtttgagaagagttttactgctgtgttagagaatctggagagaattcgtggcagatacatagaaaaataagcaaatgaaaaaaataattatggattttaaagaaactaaatacaagaaaatacaattgcaacaaacaaaaatataagaaaatacaattacatacaacaaaatgcaagaaaatacaatttaaagaaaatacaagtagattttattggttggcttttaaataatattacatagtcctaaaatatgaatactgtgctaaattttagtattattattattattattattattattatagtgtcttactgttgcccaggttgaaatgcagtgacatgatcacaattcactgcaacctcgaactcctgagcacaagggatcctcctgcttcagccacccaagtagctagaactacacagctattttttttcagagacaggatctcactgtgttgcccaggctggtcttgaactcctggcctcaagcaatcctcccacttcagcctccccagtcactgcaattacaggtgtgaggcaccatgccaagcttgaatttcaatataaccaaaaatctgtgatttagctatttggggagaatatagagaaaggggctggggaagcaggcttataaaagtgctaaattctcatcttatattcaggaaaatcagtagagaatatctaaaaggtataaatcaataagtagctccagaggtttttttttttaaaaaaaaatacagctgtttaattgaaagagttaaaagtgtgagaaggtgtctctaaggaattgggaaggggcgggaagcagggaactgctttttgctttagtcctagcaccactagacttttataactatgtacatgtaatactttgttagaaacaaaaattaggttgaaaatgaaatgctgtccatcagaaaatgtgctcagaaagcttgaagttggaatcctatactatcttagtctgttcttgcactgctgtaaaaaaatacctgagactgggtaatttataaagaaaagaggtttaattggttcacagttcccgcaggctgtacaggaagcatgatgctggcatctgctccgcttcttgggaggcctcaggaaacttacaatcatggcagaaggcaaaggggatgtacacataccccgtggatggagcaggagcaagagagagaagggaaggtgctgcacactttaaacaaccacatctcataagcactcaatcactatcacaaagacagcaccaagggcaatggtgctaaactattcatgagaaaccgcccccaggatccaatcacctcccaccaggccccacaacattgggggttacaattagacatgagatttgggtgggaacacagatttaaaccatatccaataccaaataatcactggtcggattcaagtaagtggctgctatgaaatttgtgtgaagatatgatagtgcattttctattgatgcttaattggggtttaaaatgatgtgatgatggagaccagcaagcctgctttgcaggctcagccccgctctcctgcactagctagaggtgcctccctggttcctcttgccacacgtgatgagccctggccttgcctaacatgcagtcacaaagcttctcatgtgattgactcacttccaagctgcagagccttcagtgtcatctcgatcattctgtaaagcttttgactccagccccgggctgggtctccagtccctctctacctgcctcattattctgttactgttgactgacccttccagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgacttccccgtgaatgagtctattcaagagatcaaattagattgaagttgcttagtgagcatagaattagaataaatggaattgtggtctatagagatatttcatcacacttgaataactgatggaactacttttctcctctctgcggatatttctgtctgaataaccagtgctgggcctcaaataaatactgacatgttttacttttagctttcctttttctagaatcattttagacaactgcccttctgttaatacatcaccacctcagaaaataagaaggtacttgattggattgaaattttaaaatgttaattgcattcgtatcctggggatacagcctaaagagacagaattgctttgcttaaggctgaagtctggctggggactttgatctctgcaggctctcgggtccttaaagggctctcacccaattaggatgagctgaatccttctggccctgggcctcatctttattccctcccagcttcaggactctctgatgagcgagagcgtagatttaggttttctcacagaggtgcacctgaacgcctcttgctgtgtagtaaggcagatgttgaggggggaggaaggcttacccttgataactagcaacttgagctttgcaaagcgcctttctgttcctgttaccagtagcctacactacatcatacaatattctcctccccaagaagaaagcaacctatttgcctattttctcctactgaaatctatgattttatactttgtttaaaaaaaaaatagcagccgagcatggtggctcatgcctgtaatcgcagcactttgggaggctgaggcaggtggatcacttgaggtcaggagttcgagaccagcctgaccaatatggtgaaaccccgtctctactaaaaatacaaaaattagcctggcatggtggtgtgtgcctgtaatcccagctactcaggaggctgagacaggagaatcgcttgcacctgggagggggaggttgcagtgagcctagatcgtgccactgcactccatcctgggccacagagcgagactctgtctaaaaaaaaaaaaaaagaagaagcttaagactgcactaagattaggaacacattaagaacagtttttaccctaatgaagatatttacaaacatattttgcactagttccctgtttatgtattacctgcgacagtaattaataggaatgccattggctgagacagcttcagagccctagatacctagggaagcaagccaaatcctcttcaatgtaaatactgaaacgaaactaagcttatcagcaatcagaaaccaccacctaacctctaactaaagactttccacattaaccaatcaaacggtttctttgtcttgcatccacaaacacatttctctctctccaaccccgcaccccagtagacaacttgaattctggtgctgcccaattcacgaatcactgaatgtccaaataaacatgttaagattttaatatgcctaagtttatcttttaacatgcctggggacttatctagatgttgctatattctagacatttctaaaaacaaaaacaaacagcattaattaaataagaccatattttaatatttcataatttaaaattatgacttaagcatggcagaaccaacacaaagtaacttttatttgaaaatagtagctcaatttaatattgcatatgtgtataatttgcataaaaggaaggaaaaatatcatttgtgtatgaatagaaactaatggagtgcacttagttgattcattgtgccttttggagaaaagatatagcaaataccgtgttttttaaaaagcatacatttggagtttagtatcagagctcaaggctttagtaactgctttaaatcacacccatatattttagtctttagctgtgacagtaagtgtactcagaaatgtgcacattaaaaaggaatttctcccctgaagatgaagttgagagccaactcttgatcccatattaaattcttagtccatctgtcctaatggagtctgagtaacgcagtttggtgtttttattgcatcctgcgagctgcttttctcctggaaacactggctgctctgtcaggcaatgagtggggagaggcagctggtacaatcacatcttctccaagagctcaaggacagaggctggctgagagccatttggtgggctcactgcctcatccccatactatacaacaatcccacaggccagagcctcacctgcagtccccaggaggaagtaggaagggaagagaaggcaactcacctctgagagtttggcgcaggagaggtgaggaaactgccctagcctagtctggtcacttctgcctcgttcccggctcctcacctcctccaggctccgtcagttgtattcctgaagcacctgcaccaggtgtctgggtggccgttgacacaggagtgagcactggctcttccaaggcagaggtggatgaaaagcaagagcaaactaccaaaaactttgttcttactttgtcatcctgaggtttatctcagatgctgcttgcaccagaccaaagctaccagtacatatgcaggagttcaaaacagcccccacccacccacagagtaaccccaggggcttctcccaattgttgtgtctattggcatttacttcttagagtcccataggactccttggtaggaaccccaactatatcaatctttattgttatataattataaaatattgtttatcataaatattataaaatattttattgtacaatttatagaaattctatattaatatttaattttatatagattgtatatattaatactttaaatatctttatatgtaaatgaatattatatagacacacatataacttttggaaagtcaaaaatatatttgtgaggatttggtccaatgttgttcaacagaatgagagaaaataatgactattgctaatggtacttattaaactcaagcaatgggtatctgttacatgactaggctgatcagggtgtgagttaacctgatttttttgttttcttcccacagggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtgtgagtataagttgcttgtcaactcatggggagccactttcgtcacctcagggtggtccgggtcctgattgtggaaggccttttgattcaaacgtggaaggtttcctttgttccaggagcaggactagaggtggacacacaagcctgagtttgggctccaacctcagtccctgtccttgggatgctctcagggaagcaggcacatccagattctcaagcaattagtcaagaagatgagagagaacacaccgccctgagaatgtgggagaggaatgtttatcttcagcttcatgtcttgtgtggctgttttccaaagagacagggtcaaaaataggtgaggggtgtgtgcattgacccgaggagcagggagtgaggaaaatcatgtcaaggtcaaggaagacaggaatgataactagtgacatccgtgtgagttcaggaggccacggagaccacaggactgggcaattccatgacacagagtctgcaggattcctacagaggacccacacctgcccaccctctgcaagtgagttctggatgtcatgtacttagccaaagatacagagacaataagaggcagagcaagagaggatgctgcttagctcagctcagctggccttggagcaaacatcctaagggggcgttcaggcttggggagctccgtcagtggaaggtgggggttagctgcacaagacttgagaagcgcaatgcttgccctacctggaccctttaaacatcagggccccaattcagctttaggaagttacaatcccctgacttccaggccagttgattatttgcaaatgttgaactccgttggctgtgagagtcagggagactccactggctgtgagagtcggggagatcaaccacaaggacgaggccaggctatgtcccctgtccctttacaaaacctcagccttacactcagcatatcaaaaagtctcccttccggccaggcacggtggctcacgcctgtaatcccaccactttgggaggctgatttgggtggatcacgaggtcaggagttcgagaccatcctggctaacacagtgaaaccccatctctactaaaaatacaaaaaaaaaaaaattagccaggtgtggtggcgggggcgcctgtagtcccagctacttgggaggctgaggcaggagaatggcgtaagtaaacccgggaggcggagcttgcagtgagcctagattgcgccactgcactcaagcctgggtgacagagcgagactccgtctcagaaaaaaaagtctccctttgccaagtctgtcccctttaaatgagtgcttatgttcctgggtctggtctgagaatgatcccaaatccatttcccatttctgctgaaatgctattggattcacagtagcattcttaggttcaattccacaccgtcaggtaaattgctcaatctctttgaatcctaattttctgatttataaaaaggaaatgttaatttgtgggattgtgatgagaatagaatttaaatactcataaggcatttattttggtatctagtagttattgtaattatcatcttctgaggatgcccatggcagatctgatctgagccaggtctgattgaaagggaggctaaggctatcctggtcctagaattaaaattaactaattaattaaaatcccccctttactgaattctggataagaataattgaaaggggattcttgcttccctcagttaaaattaactaactgaatcaaactattttctgacttctacataagttggatcaaattttagaaagattttatggccacaaaagaaaattgccagttctatatttgagtggttctgtaagtttctataaaagtgcttggattcccccatctttattttatgtcctcaagttttgtaaagccacgcctgggtaagaaggaacacatactagatagagggagagcaggtgtttctactcagccctcggggtcaaagaatttctctactttcttctacttttttctttttttttgagacagggtgtcactctgtcacccaggctggagtgcaatggtgcaatcatggttcactgcagcctcgaattcccaggctcaggtgatcctcccacctcagcctcccaagtagctgggactacaggtgcgtggcactgcacctggctaattgttgtggtttttgtcactgcgggatctcgccatgtcggccaggctggtctcaaacccctgggctcaggcagtgtgcctgccttgacctcccaaagtgctgggattacaggcatgagccactgcacccagccactaatttctaattatgaaaaatctttagagctgtcttcagagttttccaggtctttccacagtatgaaaaccatgtggcccatggttcacagtatgaattacagcctccttttgtcaaatacctttactttcactgtatcctttactctgggcaaaaacatgtgaaacgttcaagacccagattcgagcctctaatcttccctcagagccccctgtatctactaataaccagagagggtggaaagacattttcacgatccccaaaatgtcacatattagatgcccatcattatatgtcatctccatcagggttcaaaggagcctcatggagagggaggcagacttctgtatttaagaaaaactacaaagcaaaccaaaagtggtgctttcatgaagaacatggagaaaaaaatggccatgatggaggcttgttgctgtcgctgtctcatcaatcacactttttctttaatttttttttatttttttttatggtgtctcgctctgtcgcccaggctggagtgcagtggtgcaatctcagctcactgcaacctctgcctcccaggttcaagtgattctcctgcctcagcctcccgagtagctgggattacaggggcccgccaccgcgcctggctaatttttgtatttttagtagagacgggctttcaccatcttggccaggctggtctcgaactcctgacctcgtgatccacccgcgtcggcctcccaaagccctaggattacaggcgtgagccaccacgcctggccgctgatcatactttttcagtcagacacttcgccatcaggattcctgagacattgggtagagaattctctcaggcccacttccttgtgtgaggaatcactctgcaaacctaattgttttcacaacagtggcgggctaccagaggggcctcaggaaacgttgattctgaagttaaactctttagaactgtctctatgtttttcccatttagcttgttaggccttctgatctctttctgataggaattcacattttttttctctaagcgtgtctcagaggaatttggtcacagttcatgactacatattgctttccagaatgacagttctgttaattaattacattgtgcccttctgtcaagagtggaagattctcgactcagaaaacaatgagtcagtgtacactaagttaatgagataccatcagcatcttatgcacaagtagaaaaacacagagataaaattagggcaatctcactcattagcatgctttaatggtaacattttaaccctatacttcatgtatttactattcatatttattcattcatttaatgagtatttactgagtatctactatgtcccaggtacagtgctagtgctgaggtaatttagtcaaatcaagtgtgatttctttccctcaaagatctttctgtttgttttagaaagcaggcaagtaactcaggagttatgataataacaaaaatagctcagcttcattcagactttcaggcctcgttccaggcgttttacgtgaatcatctcacactcctaaccaccctgtgaagtgcatactagcattcacatctccattttacaaacgaggaaactgaggcacagggtgagcaagttgcctggccaaggtcatacagccaggaagtggcagagctggtgtttgaccccaaacattatgtgtctgtcccaaagtcattgctgctaaccttaaagcacactgcctcacagaacagatagcaagaaagaggccgggagcactgaggggaatttttaaacctgactggcttgacaaggagcgcctcccagggatggaatgctttaattaaattttgatggataagtagaagccagtaaggtgaagaagtgggggaagaacaggagccagggaaaaaaggaagtttcaggataacaccaaatgaacgaaggtgtcggagactgaaccgaaggacccaggaggggacaggtgcagtggggaggggcaggggccagcaatagcaaggtgggcacagatgagcacccaatgcactctgccagggggagcatctgactcaacatgaccctgaaggctatggagagccagggcgtaacttgatcaggtttgcattcaccagagaaaagactggaagccagacaaccagccatgggagcctctgttaagacagaggcagaatgcatagaaagagaggaagacagtgatgaagcattgtagatatgaaagatccttcaatgagccgagatcacaccactgcactccagcctgggtgacagagcacagagcaagaatacatctcaaaaaaaaaagaaaaaaaaagaaagatccttaacagatagattccacagacattcaacaaatactcgtgagggttaagtggacgggaagatcctagaatgaaaccagtgtttctagttttgatgttgtgtgagtggggcacctttcatgaaggagtctgacattcaagagcaaaatacaaactgcattctggatattttgagactgagtctctgtgggctataggaggatctaatcaagtggacacatctagaggatgctgaatggacaagtccagaacccaacagagaggtctcagaaactcagtttgggagtcatcatcacttagaggatcaggaaataagcattcagtaccctcagcatggatgagattgcccaaaacaaatgtgtagagagaggaagcaagatgtacaagaaagacaaccagctcacacctgtcatcccagtactttgggagtagcagtaggtcacacctgtcatcccagcactttaggaggctgaagggggagtatcacttgagcccaaaagtttaagaccagcctgggcaacatggtgaaaccctatctctacaaaactaaaaataaaacattagccaggcatggttggctgcacctgtagtcccttagcctcctgcccagaggctgaggcaggagaatccctcgagcccaagaatttgaggcagcagtgagctatgatcacacagctgtaccccctagcctgagtgacagagcgagacctcgaggaagggagagaaggaagggagacaaggaagggagagcaggaaggaaggaaggaaggaaggaaggaaggaaggaaggaaggaaggaaggaaaaagaaagagaaagagagaaacagagaaagaaagaaaagaaaaaggaagaaagaaagaaaagaaaaccacattcaaggaatagaaggaagaaaactagtttgcagaaaactaacagagaagtaggaagacagtggtacccagaaaccaaatgaaaaagacatttcaaaaaggaaaaaaagagggttagatattgctgagaggtccctaaaacaaggacataaagtgaccatcagatttaacatgtagaggtcacggtcaaaaagtcaggtatcactagggtgagtggaagtggatttggagatcaagagagggtggttttgttcattctagtttgaggatggtagagactttagcattcatatagttgaaggagaaaactatggtagagaagggggattggtaatacaggagataaagggactggctgaaggagcaaggtccccatggctgtgggcatgaggtagacccagcatcgcagcacctcacaggggtgagaggaagaggcggaagtaaagagaacagcgtaaaccgcccactaggaagtgcctttccaaatcagaatttgttgttgttgttgtgtgtggacgtttgtttgttagtatttttgagatggcaaagaaatattgttcaaaaaaaatttatggagcagatatcagaaaacccagactctaaacttttcttcatcactaacaaccatggatctgtccatgtattttttcagttacccctaagggattagcttgactgctctagatcctttttctgactgagagggccatcataaccagggtcccaacctcgggccaccacctcctgagcacctgccctactgctggtgctgggaggcgctggggaagctgaggtggaaacaggagaacccagcatccacctcctagtgaaggagacaaacacattagtgacagtgtggatacataatttcattgagagctttgcaagtgccaggccctgttctaaagcttttgtaggttattaacttttgtagtttacacagcaagttttatacacattttacagctaaggaaatgagagcatagagttgacactgccgaatccagatatggtgcatttaatcgttaaaataagtaaattacaatgataggcacaaagtattatgaacaatcggtggagaggtatgtgacctatcctgggaatgaaggggaagatgagggaatgcttcagttgggtcataaaaatcaggcaaaaaagttaaaggaatggggaaaagaattctaggaggaagaggcaatgcgaacaaaaacacaggaatggggagtgtgatgggcgtttgggaaactacaagcattttgtattgttagagtgtgaagtatgacacaggcagtgaagatttggggtcaagtctcagatctcattctaaatatatggtcatctaaatatttatctagtatttattgagtacctgctatgtgtgtacctaaaatgaacgtaagaagaagacatggccccatcccagaggcacacaccatctagtgggaaagactagtaatcttaatctctctctgtctctttctctctttctctctctctccctctctctctgtctctcttttaggttcaggggtacatgtgcaggtttgttatattggtaaattgcatgtcacggggatttgatgtacagattattttgtcacccaagtaataagcatagtacctgataggtagtttttccatcctctccctcctcccgccctccacgcttagtacacgtatccatgcgtactcaatgtttagcttccagttataggtgagaatatgcaatatttggttttctgttcctgtgttagtttgcttaggataatggtccccagcttcatctatgttgctgcaaaggacattatctcattcttatttatggctgtgtagtattccatgatgtatatgtaccacattttctttatttgagactagtaatctctgttattataaaactgtgtgtgtgtgtgtgtgtgtgtgtgtgtgtgtgtatatatatatagttttttttttttttggacagattctcactcactctgccagctgggctagagtgcagtggcacaatcttggctcactgcaacctctgcctcccgggttcaagtgattctcctgcctcagcctcccaagtagctgggatcacagacatgtgccactatgcctggctaattttttatatttttagtagagacagggtttcatcatgttggccaggctggtctcgaactcctgacctcaagtgatctgcctgcctccacctcccaaagaactgggattataggtataagctaccacctacagccagcctataaaataatattttggataggataatattagaggtacgaacaatatgctgtggttacttagatgaggcaatatttacttctgactggagaaggagaaaagtttccttgaagatgctaacattttaaaagagccacaaagtaaatggaaaaggaagtttcaggtttagaatgccaaaggaaaaaagcacagcatcatagatggcatgaacacatcaaaaaggtgtggctccgtcatacacccatgctgcgagggttacggaacattagttaccattatatctccagggtcaccacaatgcctggcatgtggtaggaactaaataagcatttgttgaatgaatgaaatgaatgaatgaggtgctagtctgaatggagagccccagaaaatctaggtggagaagcagatcaccacgactgaggtgctggcgatccaaatatagacaaggaataatatgtggaaaggtggaaggacaggtcacggttagtgaaattttggaactcacgatttcacaggaaagcagtttgggcggtaagaagaatgaaaattgaaatggaattttgtaggttgtatcaaaaggctgcggagaaagtcagggcactgggaggccagagtagtgttggttggtcacctatgtcactgttgaggtcatcaatggtgaagacaagaggtgaaatggacagggaatccatgacccaaactttactgtcctggggttcaaacagtgaccacaatatgaacggggagaggacgagtcacaggtggacgcgaagccgtttgaagactctggagccatagagtggaagaagtacggagaagggaagaataggccaactgttcgcctggccccaagatatgggccactcagaaaaggggttacaattctaagggttgtaagttagggtccccttagggtggactgcaatcagaggaaggaagtgtttgaaagtgtttaatgatacaacaaatagtgaccatagagtctatttttgtttaacaatttaaaagagattttagtctgggcacggtggctcatgcctataatcccagcactttgggaggccgaggtgggcagattgcttgaactcaggagttcgagaccagcatagccaacatggcgaaaccccatttctactaaaaatacaaaaattagctgggcgtggtggcacacccctgtgatcccagctactcgggaggctgaggaacaaggatcacttgaatccaggaggctgagattgtaccactgcactccagcccaggtgacagagcaagaccctatctcaaaataaataaataaataagattttagaggacatttgtgaaggggatttttggagggaaattttgaaggaaaagctcactgagtaggtaacattcaggaaaagcaaccagaaactgttgtaatactttaacataagcttccatgttgcccaagtttgagatttttaaggtatcaggataacttggagggaatatttgcatttagcagacatatctccacaaaaatgtgcaggcagcggcctaatgtcctactaatcttaggaaataatatgaggaaaaactttcatgttcaagatgcagccttatgcaatatacatgctcaagaaagtcagaagaaaatattctgcaatatacagaaactgatgagtcagaagaagtaaactaatggcaatttatcttccagtatttcaaaattggaacaactttttatttttaaatagtttcactcttgtagatgtgaagaatgtctaattccacttaactgggctgttgttctgttggggtgttatttaggatgttttaaaaaatattgtgttttttattagtacaaatcaggtgttagcacctggatttttcacacatatattatatttatttatttagaggcagggcctctctgtcgcccagcctggagtgcagtggtgcaatcttggctcaccataacctccaccttctagacttaagtgatcctctcacctcagcctcccgagtagctggtaccacaggtgcacgccaccacactcggttaatttttgtattttttgtggagacggggtttcgccatattgcccaggctgatcttgaaacctggactcaagcgatccacccgcctcagcctcccaaaatgctgggattacaatcgtcagccaccatgccgggcctctggatttttctttttaattatccaagccaacttgggttatcaacatggatttaggaagaattttagtgtttctactactttgcaagtctaattatggtttcaatttatattcaacatttggaatctgaaaagtgattctgacttggtcattactatacataagaaaaaaaactattctctccccaaaaataaaatttgaagacctgaatatttaataacaacacttgtgattaaaaagaaattctctaacttctcgatttaaacctttgatttgaattacagaccaaaaagaagtttggaagtgtaaactaaaatgaaatttgtgctatattaaagcttttcatataatagctttttgttcttaataaatattaaaagatatataaatagttggtaaatcaatttagattaaatttatccagatttctttgccaattacactgaagggacagttatttgaatgtacagtagaggtatcctagagttatgaagatggattttagaatagaatgtcttctggatataaaaatatttcaagttactttagagtttactggtccactcatgtcctgatctggaaatttccagagaagattgggaattcctcctaagctggccagacagagtgacatctctctacagattctagagttctgcctctctcccactacacttcagaggtggctttgaaagaccacccaggcctcctgaccagccctctcacgtggcagctcctatgggtgccacataaccgcagtctctccacatcgcctttcctccccatcgtggagggtaccttcctggtaccaggaaggatcttccatttgaagatacaactgccttcttggtaataattcctttgccttgggcccacatcctggattccaagtaaccaagggcaggctacttccagtcacacccaaagagatggcttgtccctcggctggggctcaacttctgctttggaaaccagctgaagtccaggacacaggctccccaagacctcactagagatctggtgtccttagactctccctattaaactccagcttatttacatagtcacgggcattttaggacaataaaaagaaagtaaacatcagaggcaggatttcctcaaagacattacattgtacatacatgacggtatgtcctgatttctttcatgcgatgctcgaaaataacctaagtaatccacatcgattactgcagagaagccagaagagtaactattcctggggatagctgatgtcaactaggagggggtgcaaaggaactttctgggtggtagaaatagtctttatcttaatgcaaggaatgattgcatatgtaaaaatgtatccagctgtgcattaagatatgcacattttaccgtgtataaattacagctgaatggaaaagtagaaaaagagaaaaactctgctctgagaaaatcttgaatgacaaaaaagttaataaatcactcaatttttcaactacacttagagagaccaggattctaagctgactgaccagagaccagtccttgaacctctccagactttatcatatccacttgtaaaacaagaaggttgaacaagatggtatttaaggtctcgtctaccatgaacaattcggcaaacctgccggagaccatcagccatccagtgtggcttaccacctcccaacctaagtgaactcacagccaagcagcaccttaacttttcatgccagggttctcagttctcctaaggatgatggggggagggatgtgccacaataaaacacatctgcttccagtaattccagtcagcatatatgctttcaccaaacgtagtcaggagatctcctaacattattgccacctaattgtaaatgctaactaaggagccatcagaatggcccacgatacctcaagctcaacatatcgaaactgaaatccatcattttcactcaaaagcccccttctgtgctcccacttagttaatgtcatggccatcttcttcattattcaaattagaaaactcaatgtcctatttaaagttttactaacctccccataggggatagactgttttatcttgatagaacactgcatttttaatataaagaaatgctattcttcctgtaagccatcataccagaacaatgccacagaaagcatcaattcctactagtcataaaaggcagctggaacatagatgtgaacataatgaaatcataccaaatgtctctacctcccaggatggctttgctagttgaaatccctggattctggattcagacaggctcataatttgactccctcactccagtccctctatcctgataaccaccctccctagtgaggccaaatttctacagatctggtccagttactcctttccttacagaccaccatgattccccctgtgccttataagacaaagtacaatcccaagcttggtaagtgatttacggcctaacttaattttcaagtttttttcccctactccatacaagctttgcccctcacccaccagcaccatgtgccacagcctcagctatgtccagctactgatattccctggacaccactacagtttcctaagactgactatgtgtctgcctgttccggaattgcttccccttcattgaaatcctgcccacacaaaattttttttatcattttgcatcttgatttataatataaaaaataagacagaagacttcatttccccaaaaataccaaaatttttacaagacaattcattaggtgcattgcctggaaagtagcaggaatcctcattagtcagcatcttcacatagcatttgtctgaatggagtagtttatcattactccaaagacatactgaagtttcattaaaattttttgatgtaatttttcttctatctcactctcttggattctaacgttttcttttctcttttcttcttcttttttttttttttttttttttttttgagacagagtctctctctgttgcccaggccagagtgcagtggtgcaatctcagcagctcaccacaacctccgcctcccgggttcaagcaattctcctgccttggcctcccgagtagctgggaccacaggctcacgccaccacgcctcgctaatttttgtatttttagtagagacaggttttcactgtgttggccaggatggtctcaaactcctgaccttgtgatctgcctgccttgacctaccaaagtgctgggattacaggcataagccaccacgccctgccaacactttccatattatttactctatgtggtagttcatgaaacctttcccttctaaaagatggcctgttaaagtgtcaaaaagaccaacaactagaattggcctgcctatgaccatctgtaagacaacagaccctctaagagaagaaatcaaagaagtttgaattcacacattctgagacagacggaagaaagatatgctattattgctggataatgaacacatggatttatgagaaaagcagaaatatatatgaaaaatttaaattataataaggttagagactttccatctgccattctaggagctaacagtatctccataggcttgatatttttataaaaacaagtgcttcaagaaaagagttaacagtcagtcagtgtgtgttgctaatgctggagaattgattcaactagggatgacacttgggaccaattaattcaaagctggctttaaaaaaaaaaagtagatacaataaatcagggagtagagcttcatttaaatatagtgagggactgggatagattacttgaaaaagctcagaaccaaagattgtctcaaaaggccaaagacaactataagtaaaacaagtgctaggtttctataagctatcaaacactgaaatcaaaaccatgaaagaaaatactggccaactggatgtcaactggaaaatttatacaaagtttgttaatttgtacttgtatcccctcaatctataaaaattttaaaacatgttttaaagcaacaagaaataaaaacagtttgttataaatgaaaattttcaggaagttatcgttctcaagatgcattttactgaaattacaagacaatttttaatagcaatcaagtaggaaccttgaggagaaatggggaaacgtaaagacttacatgaaatcttatacgggagtgtggtcacagtaaaaatatatcttctttaaaaagatgtttctatttcttttgtattgctgttttacctttaattttttaattttttttttttttttagtttaggtacttctcaatttttaaggggattgtgctctagaagtttctgatctagttgttcagaacctgaaatgtattttaatgtagacaccgcattgtatatagcactcacattccatagctaaccgtaaagagctctgctgttgctgtagttgagtgttgattcaaggtacacaggacaggctgagatctgggtcctggcttctggaggccatgagatgtagaatagaaatgttgaagaacaaaaagaattgtttcttgtatttctgaaggtcaagcttgagcatgacaaacttctccacagggaaagtttttatttgcctttttgatagtcaaatcacggtcctgcctctccttttgttgggagcctcattttggtgggttagtaaagggaacatctccaacattcataggagcatttgtttaaagggctcccacgtggcttccagccacttctctccactctgaaacttctatgaattagagaatccccctaattcattcaaatatattacggcctatatttttttaatattacaatgatctgacacagttgggtattgaaaatagagtaaaaccattacaccacaattatcccttcatccctgatgaacatcctcttgtccatttttttaatcatacgaataaatgaaaaaaatgtgataaggtcataagagagttaggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaagtaataataataataatatgcatgctatgctctggtccatgaagaccttccacacagtgatttagaggttcagactccttttctctgtggctccaccatcgtctagagcccgggaagtctagctggcaaagagagaaagggaggatagagaagcattctctcttcttgaccacactgaaccagcgtgaacacattccttgccctcctccctttggtaagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaaggtaagtttccaggagatgcagcatttgatttgcattgaaggatgacaggcaaaaatgagataagggcatttttctggagagaaaacagcataggcaaatgcaggtgggggaggaagaccgtgcaacatagaagcaattgaaaggaataaagccgaagcccaaggaccacttcaaagatacctctctctagagaaatgacccaccgcctatctgttaagagtttgacaaatgaaatctggctgaacctcaggccttgtcggaaattagtcattttgcttgcctttgcggatggtgttaaaatgatcaaatttggttttctgcatctctgagtttgattcctctgatgagaactgatgcgaatgccaactgactttttatgaagagtggttgatatttagtattctacagagtctttctgggtaagtgtaaccagagccagtgaataatagaagcagtgtatatctgtcaagtgtaattataacactgaattatgctcatcctgcattccggttcctgtatacattagtttaaacatcagaacatgctggcatttcagacctgtgaggattttactttgaaaaatagcatgcccttgtttttagccatttttaacaggaaaaaagaacttatatcttgttcaaaattattttatggtaaagtttgaccactctgttttttaaaaaaatcttctcaagtttctaaaaatagggaagaaatgaggaatatttcagtctagttttaaatgccctctaattttctgtatttaaataaaatcgtatacaataaaataatatcttattttgataaactgaactttctgattaaatagttgttaaagttacagaatagagttgcttataaagtcaccaatctttgccagagaaagtggaaattatcagattgtaactttaaaattatgcaagtattgtttatcgttgaatgatttaaaaattcagagcagcaaaaaggacaaaacaaaaattcagctataatcccatattccaatatatttaaattatcattttggtgtctatatttctaaacatttttctatgcatttatatatactttttttttacaaaaatgagatcatagggtacatactgttttgtaacctacttttttatgtaataatattttaagaacacattttcatgtcatttttcttaagactccataacaatatttttttttcaactgagaacaaggaccataccagaatctccaagagggcatgtgtagtttgaaaacttataattttatatttagaaagaaaacccaaaaatagctattgttttggtaatataacctacagaatataaagcatagaaatttccaattggctggtcggatgtttatctgggatcttctgaggtttgttatattaccattagcctcctacatggggcatgattagattactatgtcaacaaatgggagcacagattttgaaagattgtgaaatacagtgcctcaactgccaagcattccatttaacccacagtcccttgctgttgggcttaacttttgaaagataaatttccacacattctgatccactggcttctggttgctcattcccaatcataacatatgatagcatactatctattttaagtatgtgatatgcgattgctttttatcacatactcacatatcacagcctcaagctgcagggcagctcaaatgatgaaagtggaagacaggccgggtgcggtggctcatgcctgtaatcccagcactttgagaggccgaggcaggtggatcacctgaggtcaggagctccagaaaaacctggtcaacatggcaaaaccctgtctccactaaaaattgaaaaaatagctgggtgtggtggcaggtgcgtgtaatcccagctactcgggaggctgaggcaggagaatagtttgaacctgggagggggaggttgcagtgagccaagatagtgccactgcactccagcctgggtggctgagtgagaagaagagaagagagcagaggggaggggagggggggaagggagggatggggaaggaaggagggagggagggaggaaacaaggaaaccacactggaaggaggaaggaaggaaacaaaccacattgggaagagagggaggaaggaaggaaggaaggaaggaaggaaggaaggaaggaaggaagggagggagggagggagggagggagggaggggaagggaagggaggggaagggagagggagggggaggtggaaggaatggagggaacggagggaggaagggagggaagggagggagggaggaaggaaagaaggaaggaaagaaataaacaaacaaggaaaccacattgggaaatccaagcaaagatgggctcagcaggtcacatggtttggatatttgtccctccaaatttcatgttgaagtgtgactcccgatgttggaggtgggaacctagtggacagtatttgggtcatgggggcggatccttcatgaatggcttggtgctcttcccatggtaatgagttcatatgagatctggttgttttaaagagcttggcacctcctcctcctctctctcgcttcctctcttgccatgtgatgtgctgctgttccttcaccttccgtcatgagcataagcttctgaggccctctctagaagtcgatgccagcactatgctcatatagcctgcagagccaagagtcaaataaacctcttttctttataaattacccagccctaagtatttctttatagcaaggcaaaatggactagaacagctggatagtactgctaaccgatgaccctatccccaaagctgtttccattcattctctttgttgagagtatgtcaaaccatcccaggatggaggctggagatgagtttaaccccacctgcaactgttctctcgatggagctactctacagaaaaatcatgttccattagttcactaaatcgtaacaaaagtaaatgtacttgtttgaacattgtacaaactagtcctaaaagggttctcacgtattttatatgcgcagtctttagggaggcaaaaatgttttatgcaatctatacaagaaagttatattttcagctgttatccaaaacaaaggaagcgtactctgtgaaaaattggtattattgtttaacaatatccatttccagaggaatgcttttcttaagtagaagttggctgacacaaccataagggatgctgtgaagtgatttctgtcatttttcatacatggaaacatatgaactcaagggtctactaactcttctacaactttaaaggagcacttatcctgggatactttcaaacctgagattctgagattctatatttttaatgttcaacccttagtttcctcatttctaatattcattactaagtagacgataaagatcaagttaagcatagcttcagaaaaactaataaaataatttaaattggttatgcatctcttgtgacgattctaaggcaaaaggcacttttatagaagtctttcacactttaagaaagcttgctatatagaaaatgattcagttgggcacagtggctcacgcctgtaatcccagcactttgggaggctgaggcgggtggatcacctgagttcaggagttcgagaccagcctggccaacatggcaaaaccccatctctactaaaaatacaaaagaattagccagatgtggtggcgcgtgcctgcggtcccagccactcgggaggttgaggcaggagaataatttaaacctgggaggtggaggttgcagtgagctgagatcacaccattgcactccagcctgggcaacagagcaaaagtctatctcagaaaaaaaaggaaggaaggaaggaaggaaggaaggaaggaaggaaggaaggaaggaaggaaggaaggaaggaaggttctcctttcctctctaatgtctctccattcccatttaaagtctctgttgatctgcagcataattttacttttttctccactatttgtccaatactgcaaatgcactgtagttgaagagaatctgttgttgtaatggaaaacagaatcaatctctttttatactctgagcctatagcatgtagtatatatgtcctcatttggcactttttaattttcattacagagatcttctctgaagtcatatcaaggtgacactgaaaggatttgatagaaaggaaacaatttgtggcaaaacagagagagaaaaatactacctgtgatacaacctatcggcagagtcacaagtcagtccacagaaaccagaaaacagacgtccccttggctgctttccttctgatagacttatctaaagctctcactagcaagcatgctccttccaaagccatagcctttcatcctcagagttcatctttggcttttcctcattatcagtgtccctatcaagatagccatgcatagcacagttatttagaaggcacaattaattgacttgtatgctgtctccttgtaagcttcagcttggtctgtgttgaaacttgtcagcttttcccccaattcatgttgtttcaacctgcagttttattacctcctttggatgccaaattctcctttctccttgcactctccaaagccatgtattttgatgaactggctctctctgacatcacctcaaaccaacttaataaatcacccctagtcttctaccaaagcacatttccttaaatgagttttctcattttgccgcacaacctgaatatggtcggaagaaacacttctttgaagtccatcccctcctcaatctgctctcctcttcatctctaggggatccttaggtatgagtttcagagtttctctaaagcagcttctgggtttccctttattacaacactctatccccagagtaaccatctgggacctttatctattcttccaaaatgggtactgtctgcccaatgaacagctgtgctctttccaaacaagagggtatttaaaacccaactgcaagtcctacatggggtacaggggattgttgccagccacatatcattttggaactatttttgccttctttctttttaaatcatataggcctattaatattcaaggagttattctcaaaaggtggttaaatgcatagaaaaactaaaattagaagagctttgcattttaaagacagctttctgtttttgtatggccaatggtatctcccttttgcttccttttctctgtggatgtctttgtttgtgaagttattttttaaccataataaaaagcttaaaggccaaaatacataaagagaaatacttcttatactcaagaggttatcgagataccagagattttaaaatgagttcgtaacattgattcctaagctccaggcatttccttgaagaatttccagaagacttcaaataaatttttcttgccaatgttcattttcagatgtgtttaacaccaagttttctggtgtgaatatgcatatatgactctaaaaatctctacattcagaaactaaaactatactaaaagaaaaataggtcattttttatttccttcataatatgacaggcaatacagtagttaggaaaactaaagctctatatctagtcattactggattttagtgtctctcagcctcagtttcctgactaatcagtgagggtgggctcaggggtcgaagtctattcactgaagcttttaggtcttaacattattggattcaatcacatacttcttttttttgagacagagtctcacactgttgcctggtctggagtgcagtggcgtgatctcggctcactgcaacctctggctcactgcaacctccgcctcctgggtcaagtgattctcctgcctcagcctcccgagtagctgggattacaggcaccctctatcatgcccagctaattttttgtatttctagtagagatggggtttcactatgttggccaggctggtctcaaactcctgacctcataagccacccgcctcggcctcccaaagtgctgggattacaggcatgagccatcgtgctcagcctcaatcacatacttctaagctgatgtgattgtttctgtttttgtggagttacaaccagttgcaaatttagagagaccacattccccataagactgcatatgcttctgacaccaattgcaagttcagaagttccccaaaccacccccaggtttgatagttctgtagaaggactcacagaattcactgaattctgctgccgaaggctgctatactcatgctgcattatgggtgaagaatgcacgtgaaaatcagacaggggtagaagcacagatggcagagtccaggaacagtaccagatgctgagtttacagtcaacctctctatatagattcaggagcacatttctttcctggaacgggtgtgtaacaatttgcatggggtattgccaatgagggaagcttcctgagcctccatgttcagagtctttactgagactccgttatataggaatgattgattgcccacatggctgacctcagtttccagcccctcagaaggctggagaatataagccaaagccccacacccttcatcacattgttggtcaatctggcatggtaaggccccatcttttttctttttctttttttttttttttttgagacagagtttcgctcttgttgcccaggctggagtgtgcaatggcaccatctcggctcaccacaacctccacctcccaggttcatgtgattctcttgcctcagcctcccaagtagccagattacaggcatctgccaccacgcccagctaattttgtatttttaatagggatggcatttctccatgttggtcaggctggtctcgaactcctgacctcaggtgatccacccgcctcagcatcccaaagtgctgggattacaggcatgagccaccacacccagcccaggccccatcttaaatgccatctggtgtggccctacccctaaaacacaatgttagactatctggaataacccaaggctcccaggcaaatgaagacatgcttaccaggcaggacatcccaagggcttagatattaccttcccaaagccaaaggcaagggccagacctcttgagggcaaggctaaattctctattacacagttctgaaaatctctctgttgaggacaagaaagcaaagattcctaggacttactactagaaggaaacctgaaactcctaatgtttcttaaagtaagattccaggaccacttgcgtcagaatcacctggcattaacaaaatgcagactccaaagccccaccccaaacctactgaatcagattctctgtaacagaagcattggaatatgcattttaagcattttcctttagcagttttttatgtaggccaaaacttgagaattgtaattaagatccaaggtccctgttcctacaagtagagtgaaactagcatgcaataaagcaaagggagaaaattctgcttcttattccactggtgagtttatcttgggcaagccattagtcctcaaacatcatatgtttgaaaataacgtttagctacatttgttttaaacagacataactaatgtagcatgctcttagactgagaaaatattcattgagttactttgtgctcttgggaaagatgcttgtggaatacaagatggaactccatctagttcggctggccttgggaaaatgagtggatttctcttttcagagtatccatgtgatcactgttgccttcctaggcaggagtagtttctattcatcctttcattcattcacaaattggtatctactgtgtggcaggcaatgttctcagtgctgaggagagaacaatgaacaaaacagaaaatgcctctgccttcctgaggccaggaccacatatatattattccagatagtgatacatgctatgcagactttttaaaaatcaggattaaaggggaaaggacagctgagagcgaagtttgttatttaacatagaatgtttagggatggagtttctaatatgatgacttgtgagcagagaagtaaacgctcagccacagagttatttgggtaaagtgaacagcaagttctaaggccctggggcaggagcagtttcaaatgttgtgaaggagaaagtcctatgtggtggaattagaggaagactaagaggagtggaaatagatatggggagtacagacatctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtaggaaggatggcatcccgtgtataggtgcagcagttggccttgaattaggaacatagatgaactctttacttctttctccttatctctctgattcccatggcgaccttattttcagccttcctgcctcttctcatgaccctttcgtgttaaataaatccttttatcttctgatgtacagttagtacttcattcagaaaaaaaatacaggaaacaaaaaaagatattgataacactgttcaccatagagtgaggctgaaatatctgttctaccaattaccagttttgttgtatgactcaaatgagatttattgtacagaagatcccccaggaagctgccacccctcgaaccttattttagaatggaaaaaacgtatcattaccaaaactaaacagtgttagctggtctgcccatcatgctcatgctatataactttccttctcttttctcttatcctgttctgtactgaatggccaaattttttctgctacttcaactgaaactgtggtctaatatctaaatgctccctcacctgctgagaaaacttagagccaaaaacacctggtattggtcagttgttaaatttatcgctcaatatactaagcttggagtgatttgttgagttagaatgagagcaaatagtgccacctgctggaattacacttggaaggggaagcgtgaacatgccaagagctctccatggttttgtcccaatcattactttaagcctttcagatgaagtcatgagcctgctttattagaaagtaatttcttccacctatattcttttctgatggcaatatgccaccttatgtatttctcttttagtatttctcttttctccctgtaatgattcagtatctaaaattaccattaagaccagctgtatttcattttatttctcttagaatctcttgaaaaattatagaatgttgccatttgaaagaaccttagaggttctccgtagtttcaaacacattttggacacaggaacttttgggaaactatggatataatcctcactttggacctcaaactgaggcctgaagcgtgaaaagtgaaaagaccaaacagctgaggctctatatcagttaagatgctttcagttacaataaaaatggcttgagcaataacataacagcatatctcacataagaaatcctaaggtagatggctctgggattaatttaaaagttgagtagaccaggtgtggtggctcatgcctgtaatcctagcacactgggagtctgagatgggtggatagcttgagcccacgatttcgagatgagcctgggcaacatggcaaaaccccatctctacaaaaaatacaaaaattatctaggtgtggtggtgtactcctgtagtctcagctacttgagaggctgaggtgggagaatcatctgagcccaggaggtcaaggctgcagtcagctatgatcacactgccacactgcagcctgggtgacagaacaagaccctgtctcaaaaaatacaaataaagaatttttaaaagttgaacaatgtcagccatgacccaggctcatcctctgtcctctctgtcctctgtatctctgacatttgtgaggcagctccagcaacattaagaaccacagcttcccacccaatattaaggggcagaaaagggactgtcttttccttataactcaccaaaagactccactcatgtttcattggctagaagggaattatgtgtctcatccaaagtgggtagctggcaaggagcctggaattgccatctttgccttcattaaatccagatccatcctgtgggccttgggtagggctgtccttatgcaaagtgcaagactctggaaacacagagattccagggcaaaatccggttagctcacaaagaaaaaagggaaagtgactaattattgggagaaaaatctccatgggtctcttccacttttgcctgccttctgagcaagaagcattgacagctttgtttataccttttttaaggatgtgtgtatagctaacagccttggaagatacagatagtgtcttcctctgggacagagggtagatttatttcatggccagagtaagaaatataatgtcactctccggggcagaaattgagcaagtttgctagtagctactgtaaaaagattggggtttcctaagtccagggtccctcagctgtgaagcaaacttattgcatgtgcagcatccacctgggatgccctgcattcccctgcaagggaaagcaatgtgaacgggaagctcaggctgcctgctgtgttgtgagtaaagaagtcctttgtctctgacccaggagtttcatgtcttctgccagcatcatcagactgtggccatgttaaactatggttctgccagcatcatcaaaccatggctaacttgttagcctgcaagtggggtaaagtctcagacccttcccagttcttgatactcatggaaaggcaaccattcatgtttggcacagtgttctttccaatgagccaggctatatgcatccaattctcaaatacttatttctggaaatgagaatttgttcggtatataagaaattcctttttcacaggcagaaacagggcaacacttcagtctccaactggagacacacattaagcgaggacagtgtcattggctcaagtgtcttttatgctgtctcccttttattcgctcactctctctataattatctcttttaaaatgtcagttgctctcacccagaagaccaagagcaatcagccacaaactgaacttagaagcttttaaaacacactggctgtctgactgggggatgggatttctcaaaggcttcccgcagcaatgtcagggaagctgacattgagtggctgagaaaaaagagccctttccttggctctcacagtgggtctttcagatccttcctgaggaagcaacggaaggggtgtggaatgtgctgacttcataaatatttctccagcagagcctgaatggaggctgtttgggaagaaagttgctcgtggggtcctttggccttgagtccctcttactgtatcccattagggtgagaggctctgagctacggcatcgtcctggcaactttcttcccttctccagaataaaatattgatgttaaggtgacggtgaagaaataggggatctattgggacaagcaaaaagtatagatattttctagcgacttctggcactcagagtttttccaagtagtgacagtttgaagacctggacacgaattcatcatagcagtaggagaatcacagaggaaattagaacagcatttatccctacgagtcaaaccttagggttaaactcaatttatccctaaattctatttccttgatggcagttgatgcctttaaaatgaaacaatctttcctacttagcccaggaaccctcgttctcttgctgttctgacaacttacatttaaaaaatgctcctgctaaaatacagtgttatgagaacagaacagatttaatctgaaaccaaggctactttttcctcatctgctgtatcagaactacagagaaagatcacacagcctgtgggtcatattatcatcttcctgcattctgatcatacttccatggaaaccttgatggaggtcactggcctgcaagttcaatccagtcccaatgacccctggaggcaggggcttctaatttagatgagatatttttctgaagtgtgtgtccaatgaccacaggtgttgaaatgaaagttctctcgctaacgacatgaaggatcaaaattccttggtacaattaggttgattaaattgagctctgtgtctaatatccctgtagctcaataaagttaatgcagctttccaaggggcccaacacagaggcagggaacagtctaggtcctgagagaatctggcccaccatggtttctaaattagaagtttgattgcttgtgacatcgtcttaaaatggtaccagccaaaagaagctgaattttccattagcccaggaaaaaaaaatgacagatatttaattaaactgcttagagattaggtggaaagcttattgatggacagaggggctgaatatctttataagcaaagttaggcactggtgtgccacatctttaatgttgagaagaattcacccagcctaagggagctgaagacgtgtgtgctgcttcagcctgaggctgcctctcctgtcaatcacaagaaaaaatatacatttaaaaagcttgtttataaagcactaggtggtcactgaggaacttaacataaaatataaaatgtgaaattagaaagctacttatagctaaagttaataaagcaaccacccaatccatttgccaattgttgagaggtgactaattgcagaggaaggttgatttggaggtgatctctaaaaaaaagaatttgtggtcagtgctagagggtaggttatgagaaggagcctacaacccagatggggaataaccaaggtttgcaacagacgatgtacgacagggattattctccagaaatgttgtgctacctttcaggtaggcacaggtggtcataaaatgtaggtcaccctcattacaccaacaataggtcaccctcattacaccaacaataggttaccctcattacaccaacaataggtcaccgtcattacaccaacaataggttaccctcattacaccaacaattcaagggtccccaactttcaaaagagtataaagatcaatgaaatcaagtttcataaattcccccaaagcagtagctctcaactctagctatgtgttaacatttcctggggagtttttttaaaataccagtgccaactcttgaccaactgagtccaaatctctggacacaggtgtttcaagagatctccaggtgactatgaatcacttcccaaggagctacttactgaaaaggtaaattgtatgtggaattagaagatatcaggctctgaaatctgacaaaccttggttcagttcgtgactccactaacttactgaatctaagacactcaacatgcgctaacttctccagacttcagtctccttatctggagagggtcaatgatggtcacatcttggaaggcttctaaaattaaataaggaaataaatatatacctgacacatagaccccccaaaacacccttggttattaatggttaatgattgacattttatccttcttccattgattttgccatcgacctttgtaggacgtgacaggcttagatgatttttcctctccctgctttgtttgtcgtctagaatttactgctatttggtatctgggagaaaaatactcatgtttttcatgctttctgctcctccagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtaagtaatggaaaggtaaccatggcttccctctgttgatttttaagagcctgcacaatacaaaaaaaaaaaaaaatcagcctatgcaaggtttgatatagagatccttccaaaagtaaaggtgttggcctcttgtagtctccttcaagacagaatggaataaggaagaagtttcaggagacctagatctcgttccacttccactcttgggagctcactgtcctcagctataaaatcagagtgcaggctgagacatctctcaggtctctctaatatctgcaattttaggtttatggttttagaagtgtataaagttatttgatcatttggggcacttgtaactgtgtggaaggaaaggaaggaaggaaggaaggaagggagagagggagggagggagggaggaaatgggctaagttcagatttttttgaaatgataaatataaagccattcctttcttgcctattctcaaggttctaggcagagaaagatttagacttttcctgacataggaaaaaagatcagtacaaaaaagaaatttaaacagatcaaaaagttaaactacctatgcaagaagtggatccagacacccagtctaatctttttcacctgtctttctgctactgacatatttcagatgaacctaaaattacttcaaattcatacctgcttcccatggctagttgaattttaaattttgtttttgagaatattcatatgttaggaaattagcaacttttcctctgttgaatgaaataaagaagtgagtttgaaggactttgtggatgcatcatcttagacccctctctagggggtcaattgatcagtgcagtcaactgtggaagtctcagacaaagcaagataagaatgtgacttggttgctgttcatattcataacacctgccacttgggctccaccctacgttacagcctcactgagagccagttaattttaacaaggggcagagtccccacagtgtctttcatagttgtgttgggaagcttgaagagcggtagaatgtcattaaaggaaaggtaaaattagatctccattcattttgtgtgatgtcggccaactacaaaacaaaggtgtgggtcaatgagctttgaaagtgagactgacttttaacaaccacatcagctggggctataaaagagttatagatttagaaataaagtatttcctaattacaactggaaatcagccctttccaaatccttccctcaagttatagatcacaaaattacacattattttttaattagctaaatatcaggtccattgatccctgctgagcacagtgaagaaatttcacttcatcaacatgtgtggcccagattagctaggacaagtttcttcctaaatactgttaattctgaacatgctgggtagattctatctggttttcatcataacaggtgaccctacttgactcaacttctcgtttttttgaccctgcccctggatatagaagtccaactttagttttgttcctttctgttggctaactgtggctgtgtgtaagaattttgaagacctagtaaggttgtaaaatgaagagatggaagagtatttattatggtcttggaaggaacatcaattcacttaaagaaggtgacccaataataacttaagaaaagagcaagggcctgagatcagaattctacagaaccatggaatataagggataaacagaaaaagaatatctcaggaagaatgaagaggaatagaaataaggaaaattaggagagagtaatgtcacaagaggaggaggatttgattaaaaaggtaatggcaaataatatcaagcaccatgagtaaaataaggctagaaatgtgcgtgtgtgtgtgttttgagatggagtctcatcctgtggccaggctggagtgcaatggtgtgttctcaactcacgactcactgcaacctccacctcctgggttcaggtgattctcctgcctcagcctcctgagcagctgggactacaggtgcatgccagtatgcccagcaaatttttgtatttttagtagagaaggggtttcaccatgttggccaggctggtctcaaactcctgacctcaggtgatccacccacctcagcctcccaaaatgctgggattacaggcatgagccaccactcctggcctgtgttgttttaatttagcaattgtaaaaccattgatgaccgcagaaacagaaatttcagaacaggaggctgacgtgatgagtcagcaatttcttttgactagaaaatagtctctagtcccagtttctaattcctgtcaccttaaagggaggcacaaggcacatctctcagatatgagctactttagccaatttgtgaaatattgttcggcaatagaagtctacctcaggtgaagtgagaggggttgttacaaaaaaaaaaaaaaaaaaaaaaaaaaaaggacggccacggtggctcacgcctataatcccagcaatttgggaggccgaggcaggcggatcatgagttcaggagttcaagaccatcctggccaacatagtgaaaccctgtctctatttaaaaatacaaaaattagggctgggcgcagtggctcacgcccgtaatcccagcactttgggaggctgaggcaggcggatcacgaggtcaggagatcctgaccatcctggctaacacggtgaaaccccatctctactaaaaatacaaaaaattagccaggcatggtggtgggtgcctgtagtcccagctactcaggaggctgaggcaggagaatggtgtgaacccgggaggcagagcttgcagtgagccgagatcgcgccactgtactccagcgtgggagatagagtgagactctgtctcagaaaaaaaaaacaagactctaaaactaacacctagttcaacagctatgaatttctggagccacttatctccaaactattcagttagaatttagggacttaggtgttagtctcagttcacctctaatataaaagcattttcttgaccaactattaccatcttccctctctgagtatcttctatttctatgttttgtttgtttgtttgtttgttttacatggagtcttgttctgttgcccaggctggagtacagtggcatgatcgtggcttactgcagcctcaacctcccaggctcaagggatcctcccacctcagtccccaagtcgctgggactataggctcatgccaccatgcctggcatgaggtctccctatgttgcccaggctgatctcaaactcctgggatcaagtgatccttccacctcagcctcccaaagggccggaattacaggcatgagccaccatgcctggcctcttccaatattagacattttttattacatgcttggtaatgattgaacaataccagggttgccaagtggtcagtcttctcacaatggtgtgtggttaacaatatggtctttgactaccacctctgcctcttgccaattgagaaaccactgacaaattgcttaatatttctgtgttaattaggaatacagctcctacaccacagtattaaatgagatattccatgctaagcactcaggagagtgcctcgcctagggcccataattattatcattattattaataatagtagtagtagtagtatttgagacagggtctttctctgtcatccaggctggagtaaagtggcgtgatctcagctcactgcaacctctgcctcccaggttcaagtgattctcctctctcggcctcctgtgtagctgggattacaggcatgtgccaccgtgactggctaattttgtacagaaagggtttcaccatgttggccaggctggtctcagacccctgacctcaagtgatctgcccgcctcagcctctcaaagtgctgggattacaggcatgagccactatgcccagcaggtccattctcattaaatgtgagtttctttttcctttactatcctttaccttttattccctttattttcttcttcctccatgtaatagttacccttctcttaaagaagcctctttcaatgggctcattacttctttcttgaaatattgacttgaaatgtgatcacttccactcaccaaccctacaggaaagctcacatgcagagatgtccctcaatattcagaattattctgctagtcctcagcttacctgcagaggccacagagcagcaaactaaggcccaaggattttttcacagtcagccaagaaatcagaagttcatctgaaaacatcacaccagcatccctgcaacagctaagatatgtgacagaatggcccaagagctccacctaggttccggaaggaagggctttcatacaaattaaagctgaaacagactgcaaatagttcttggctttgcacacagagctctacagaaggccaccttccacccactaacctgtgttaatgtaattgcctgaagggtttttcttgcccgctacacaggtaaaccaaattcactgagacaatgttattgcagtaaataaagcgtttaattaacacaaggacagccaagcagaaggactggagttattactcaaatcagcctctctgaggactcagaggctagggtttttaaggacaatttggtgggcagggggctagggaatgggtgttgctgattggttggagatggaatcataggggtgtggaaaattgtcctcatgtgctgagtctgcctcagggtgacagccacagaactggttgagttctgcgtcccaagtctggatggaggcaggtggtttccagaatgcaaaaatctgaaaaaaaaatctcaaaagaccaatcttaagttctacaatagtgatgttatctataaaagcaactgaggaagccacaaatcttgtgacctccggccacatgactcctgagcattaagggattctagaaactacacctacattttaacagagttcaggcctctcccataattctaatctcatggcctttcattggttttacaaaggcagtttcaatcttccagccaggagggaaccagttttaaggagggacaattatcatccttgctttaaagctaaactctagctgggcacggcggctcacgcctgtaatcccagcactttgggaggccgagatggggggatcacgaagtcaggagatcgagaccatcctggctagcacggtgaaaccccgtctctactaaaaatacaaaaaaattagccaggtgtagtggcaggcgcctgtagtcccagctactcgggaggctgaggcagaagaatggcatgaacccgggaggcggagcttgcagtgagccgagatcgcgccactgcactccagcctgggtgactgagcaagactccgtctcaaaaaaaaaaaaaaaaaaaaaaaaaaagctaaactctaaaccaaatacctcccatggttagtttagcctgacctatgcccaggaaggagcagggacagccaggctgtgaggctagaagcaggacggagtcagccatgctagacttttcttgctgtgtgatctttgcaaaggtggtgtcattagcgaggccaggctcacatgtccttttgcaaagtaaccgaaaaaaaaaaaaacagagaagacacagttcacctcactgcacatctaaaatataattagaagctgtcatcccaaaagggttaacacaggtcttttggaagttgtaagaatccagagattattctggtttaatcaaaaagtaacaaatacatttaaaaactaagagacacagaaagaaaaaaagcacttgctggtatttgtctgaaaagtgcaggaaacttttcccattttttgatccaaaatgagtgtccagcatatgacgagctccctggatggcccagcagaagcacttaagccacatgttgatctgaagcctcagccagcccaggtgttcggacctgggctgtccgtgggccagatttttcttaggcggtggagaaagcaaacaagctcatggtcattgtctaagcatgaacaatgccaggctggattgagcaaagccagctttggcagagacatacaaggagtttggagccctgacagctgatagcagcggcaggagtgggagaaggcaagatatctgctgggcccccagcctgggaggctggctgccagcccagggcatggccaggagctggcaagcaaacaccactgcggggagccaagcaggctgttcaggtcagggagctaggacagggttagcatgcagcaagctagacactagccagagcatgcaactgctcttggcagtcattaagggaggagatcagagttacaagatctggaggccatttcagacagcttcaggaagaagtcaagctcctaagtggctccttgacagaggctaggtcatcttaactcatgacaaatgtccgtgctcaatttacttggctctggcctcttctgatatctctctagaggttaaagggaaccatctcttttgtgcagtccaaaaaggagttgaaaaatcaccctcagtgcttcaagctcttttgcgttgggcagaaagcctgactgagactcagtggaaggcacgctgtcttcaggaggactcagagactacctgagagtggggaagcccgcagcctcttcttcctctgacagtttgtctatcaggagacttttttctcctgggtggcaacctgagtttatggaagagttgaggtttattaaatggacgtataagcaactacagactgaaatgttataaccattctctgagtccaacctccccaaattctaaaatacagcttgtttggtcagctgcttctcatactctctgtattccaaaattgcaaatggatcattccagtgccatctgaaatgcagtatcattgagagaccaaagagaaaatcgcatttgtgtgtgaaggagaaaaatagaattctaataatgaaattcacccaaatctatgtatgaataaaatggctgtttctcatatctaagaaattgataataaaagatgtacaactcaggccgggcatggtggctcacgcctgtaatttcagcactttggaatgctaaggcgggcagatcatctgaggtcaggagttcgagaccagtctgaccaacatggtgaatttctgtctttactaaagatacaaaaattactcaggcatgctggtgggtgcctgtaatcccagctacttgggaagctgaggcaggagaatagcttgaacccagtgggcagaggtcacagtgagccaagattgtgccactacactccagcctgggtgacagagtgagaccacatctcaaaaaaaaaaaaaatgtacatctcaaattgcaggaattataacctagagaatgtgtgcctgcccctgtttcctgcaaacctgcctcaaaagcaaccacgtgaatgctgactgagacaccccggtgaaccccagggccaagtgcttcccatgcttcccctcaatgagtccacacgagtctataacatagataacattgctaattcttgttttattctcacattaaagattagttgacttaccgaaggtcgtgcatttaggaagagacagagatgggatttggttccagacagtctgactccaaagactcagcgctttaatcattcctcttgtcaaagcaaaaattgcactgggcaaagttgaacaggcaaggaagatcttcattcagggctgttgcgacagggtagagaagccagaatgcagtcgagctcgcctccacttcagctaagggcaggagaattttgtttctttattttgattttttggttttttttatttcactaaaatacaatgggaaagtttttacaagctgggataggagggatcatagggtgtctgtgtttgctgattggctctacccaaaggaaaagtaaactttcacaacttggagttaggctcccaccctcccgtggaggggagacagggtgctattttccttgacaattaccatttcaaagagatgactcccaagtttttgaaaaagccattcctgggttgtaaaactggcaaacagctttttaaaaaatttatatctcaaaagggcagagaaagaattaacaataacaaattttctaaagtaagtgctcttaaaaagtgaggtcaggggtctagggtggaatggaggggtcctatgtaaagtttagtcaagctgaaggcaaagttcaggccctcttggtcagtctataccagcgtcccctgactgagatgaccctgtggcccagagggtatgtggaaaggtgcggtgacactgggtgctcccacagcttcccacaacgtgcaggagaatccatcccaaggaagatttgcaggccccacgtgcaataccggccccttgtggagcactctcccagttatggagtctatgggagagactgaagttgacaggcagtggtgaggctggacatcaggcagccctggctggtattatgcagattataaagtcgccatggcaaagatctaggcctgcagagggccactgtcaaacgcaaagggtttggtttaacgagaagttaatgcaaaagcactcttctcagggaatgagacttcttacttgacagtctctatgacatggaaataatgttttgtttttgttttgttttgttttgagttcctttggtaaagcttttataaagtcgtcaaagtcagcatggatctctaagtctcagacacattcttcggggctttgcagactctctcagcagcatgtctcctgcgctctttcctgaaatactttcttcccacagattccacagccgtgtgctgtcctgcttatttttcctaccaagctggccatcacttagtctctcctgcattccctccttcctccgcttgaccactaagcattgcagtgtcacagagccttcctgtcttctcatccgaatattgtcttggatgatctcattcagcccaccatccaatggcttctgataataatttgtgccaatgtctctcaaatttaaatctccaggcctctcttctctcaggaactctagatccacttatcctactttctactttgtgtttcaacttagatattaaatgggcatcttagaataaacatgatgggaaacaactcttgatgcctcctggaaatttgttcctccaaaagccctccccatctcagtaggtggcatcaccatctaatccacccatccaccctaaatttggagttacccttgatttccttcttccctttctttcttctctttccctcatcacttcctatccaatagtaagccctgtgagtctacctccagactgtccctcaaatgcagctgaggcaggagaatagggtctggaggcagggaagataggcagattcatgctgacttcttggaactaaatcaaatgggaacgcttcagcaatgacaggaaggtgaacggctgtgtagcttcacttcatcctctccatttacttatgccacacactgagtaacatccttgccatttacatagggtgcatactgagtaaatgactttgtcacttgacttcgtcttcttcatttacatagggcatataccaagtaaccaatgggaaacctctagagggtgttgaaaccccagaaaattattattattcagaaataaatgaatacgtttatttatgtgtcctccccctagaacgtaagctacatacagcatagacggaggatagggtccaataacaactggtcaatggttacccaataaatatttgctgagcaaacatctggatgaataaataagtgattgtgatttttctgggttaatatccatattcaaaattagatcatctcctttccaaagcaagaagggtttttccttataaactttctccagaattcttttctcaaaatgtgatgatatttaccatcttgggaaatatctttttactgggaaccacagactgaaatcaagcatgacagaagcagaagcagcaaaaaaaaaaaaaaagtcacagagaaagtcagcatattatggaagacagcatttcaaatcagtctagagcctgagcatagttttcagtcttcctgatatcaaattggggtcttgcctgtttggcggtagctgtgatgctggctgcaatcctaatgcagagtttctaccccaacctttgtaactagttcttggttctctctgggatagaaatagggagtgatgtcgtaattagaaaccattgccatacattaaagagtaaattaatttgctggacaaaatctagcaaaaaaaattactacattgaaatcaatcgaccatatgcaaagcaaaaatgcaaataaaatatagaagctcctccaagaaatgccttctccttcacagttgttcactacaagggttaccagccctctattcttttctgaacctgctgggccaccacgctcagtcggctgctatcttctcaatagaaccatctccacctacgacccccacaaagggcaaaggatagccccttcccacttacagttgccatgtatgttttctgccctttgccctttagggatcaaaactaattgacttttgcaattccagctacctttcagtcagagcattaccataggaagtgagtgatgataggtacaatgtttgcgctttttttttttttttttttgagacagagtctccctctgttaccaggctgaagtgcagtggcacaatctcggctcactgcaacctccgcctcccgggttcaagcaattctcctgccttggcctcccaggtagctgggactacaggcacacgtcaccacacccagctaatttttgtatttttagtagagataggatttcaccatgttggccaggatggcctcgatctctcgagctcatgatccgctggcctcagcttcccaaggtgctaggattagaggcatgagccaccaagcctggacaatttttgctttttttaaaatgtgctcccaaataatcaaatcaacagtgtacttttaatgtcttttgagctcccaactaactaaaagataatctgttaactatattatatgggtagaaactttacggtgaacattctgaacctaagaaactaaaggttcaccttctcatgtgtcacaagaccaaatgcttcaggaactctggtctttcttccaacatcctcatggcaattggaatggtctgatgcagagaagacattttaatgtaacggtaccacttttgcaatcaatatggaaaaatgtttttcaacaaataaataatttcttatacagattttttatctttccgataaggactgaactaaacttcatgataataaatggcaactgtcccacagaaaaagattgtaataaaataaattagtatcaatgacacaaatattgaagaagggatagatcctcgcagccccatagttcctcccacagtacactatgagcgtgagaaaaaagaggcccacttttagtattccgcattcagataaacagggtcgtttcccatcagacgcttccctctcatgtttttatctcacagtttggtttctgctccttcgtgttttcaaggccccctgatgtgcaggatattgcgtgggtctctcttcctttcatggtcctattgtcacatcctgacaatgttcctctttcattttaatttcattttattacgttttttcttcaccattgccagcttcaccctctcgccatcgccgacacccactgaaacgtattttatggatggtcttctagtcccaccctctatatatttgttcaaagtatacatatcattgtggaaattcgtgttgtctcttgtgtgccatgctttatatgggtggcattgtactacagatcccattctgtttcttactctcttccctctgccttacattgttaagatctatttgagtagttctctgaatactatgtgcatagtgctccattatgtgtatttaccacgcatcatttattctatcccctaatgatgaatacctaggttttctgcaactctgccaccacgaataaccctccagggaatatatttatgtgcattctctgccacctgtgtgaggacgtcttgtgtgtgtgtgtgcctctgtgtgtccccagaattactgagtcatagagtatgtgtgtacctaatttcactaagcactgcttgacctatcagtttctgagtataaattttaaactttatttactgaatttctatcaatagttctatcagtggtagcttcgggtaattgaagtctattttgctagttagatgtgttcatgatcttcttgatttattgttccttgtaccagtatataatttccatctttgttccttatgacatttttttttaaatctcacagttttgtctctgctcttaaaactaccacactgctgggcgcggtggctcacgcctgtaatcccagcactttggaaggctgaggtaggcaaatctcttgtgcccaggagttcaggaccagcccgggcaacatggtgaaaccccatctctaccaaaaaatacaaaaattggctggatgtggtggcacacacctgtaatatcagctacttgggaagctgaggtgagaggatcgcctgagcccaggaggtctaggctgcagtgagccgtaattgtgtcactgcattccagcctgggtaacagagtaagaccctgtctcaaaagaaagagaaaatgactacactagccaggcataatgatgtgcgcctatagtctcagctaccctggagctgaggcagaaggatggcttgaacccaggaggtcatagctgcagtgagccgtgatcacactactgtactacagcctggggacagagcgagaccctaactctaaaaaaaaaaaaaagaaaaaagataataaatgaacaaactactatgctagccttcttgttgttgctaatattcctgttataacctggtattttttgtacaggtgtttgtatccttttgtttaaatgttcctcttagatttcatattgctgaaccttttaaaaatccatttggaccaattactcctataattttgacttggcagtgaaaataaagatgcaatattttttccatctatgttctcaagacttgtgactcctgtacatggatcggaaggatccctggggctgggggtctctggttcagatccacagctattgatgaaggtgttgttttttggttttggtggtggttgttgttgtttttcttacctaccctgtttaaacacttcatgagtgccttccatttgaactctaatattgtttgttctggaaataccagatatttcttcagatagtttcttgcctgtgtttattcttttcttatgaagctactattgtgcagatgttgacacttctaccctccgtaattcttgacttttgttttattcttctaatctctttattcattcctattgtcttcatggaaggtttcttgacccaatatcccaacccacgaaaatgttcatcagctttatccgttctgccattcagcccctccaaggatatctttattttgacagttatagatttttcacttcaatatctccaactaattcttattcttatagtttgtcattgtcctgtgtctccaatatcaggaaggtgggattctgctaattttgctgccgcttcatgtcggcaccataacgcaggtgtcttttatgcaaatcctacagttttctgctgtcattggttctgtgtcttcagcgctgcttcttgcccttatttcgcagtgcttgctgtcctcagaggtcctgtcatttcgccttctgagttcaagcatattcccttgagatttccaaatgccacctttgttattgtcttcctacaatgaaaaacaaaagttcagggcctgcattgagctcctcctggaaagttgagggggcaaagaaaaactcctgcctcaggacaaacctctggcattgtcatccctctcaaccctttcttgtttccagtccatgtccctcacccacctcccatacacacacacaacttcagagtacctcactcccacctagacaggggacagccatcttccactgtcattgattcttaaaccagtggtgtatctataccactaaatctagcctctcactacccgttcctccactaataagcatcttattgctatattgaagtgtctgtctcaaaaataaccaaatccaatagcctgttactgttgtctgattttccttgacttcttgctcttatttaacaattgtcactgtgccctccttgaaatcttgacatcaaaacactccagtcttctgttttctcagcctctctgccaactcgcctcccttttcccttttcctcaatccccaagcttctcttctttttcctccacccctttgcttggatggctgacatacccatgaggcttggtcatcagagctacactaatccctcacggatccatcccaggcttgacctgggactagcatccgcaaaggcttgtatgtgaagtctgagagtgaagagaacagggtgccagcttggataataacaccagggattcttgactccggatttaaaaaaagactagatacaaatgtttaaatagagactttaaaagacagatggaagcaggagagggggagggggagatacatgaagatcagcagaaagaggatgcttattttacttcaaagatgacaaaactcaccagcaggacacttaatatgaacaataacctaaagatatttgcaaaaatgtatttagacaagagttctaggctgatatatttgacatctgggtttattaaagtttactaaaatagctgttaataattttgaaatttggatccaactagaaaatatccccactttcagatgcaacttggaactgtaggtcccacagtaaagcaatggcttctgaaatcagtgctgtcagactgagcttagggaaagtatccatcatccaccattttagcagtggccaaagcccataactgccttggtttcaaaactgtagtactgagcttttgcactaagaaataaatatgatcttaatgacagcatcaaaaaagtgtcttctctttgttggcttagagattaatttggacattgacattcctggctctgtgagtattgcatttcccctttcagcttcagccatccttgtagctttagagacaatggtctgcccaggtgcaggggctcacacctgtgatcctaacacttttggaggccaaggcaggaggagcccttccatccagtagttcaagatcagcctgagcaacatagcaagaccttgtctctacaaaaaaaaatttttttaattaaccaggcatggtgacatgtgcctgtaaccccagctactcaggaggctgagacaggaggattgcttgagctcaggaggtcaaggctgcagtgaaccatgattgcgtcactgcactcggcctgagccaaagagcaaaactgtgccaaaaaaaataaataaatataagacaatgttctggcaggtggtaaatgtcttgcctcaggtattaatcactctatcagcattttgtatacctaagtacaacaatgtctagaagcatatcagacgtaggagaagaaagtgccttatatgatgtaagcccaaaaatcaaacggtggccagagcatagtaagagtgcaggcttaaaagctatccagcctgggtgtgagttctggctacttactggctatatgacagcaaatgaattaactctcttattctcagttcactcgtctgtaaaatggagataataatatctagctctgagagtaaagttctggaatagtgcctgatacttctagtatttaattaatattagcttttgaaataaccaatagtttaccatgcttatcctgccaccatagcctctacaatgaatcagaccacttagctccacccccattgcataacatttcacatttggacacataggagtgctttatactatggaaacccagtgtcccttcagtctctattttgaagctttcttctagtttaatagtttggattcacatgttctgcatgtcctttactctgaggacacaagaaaatccatgcaataataatgaactgaaaaaaatccatcctattgatggagttatgaatgagcactcatgagtgtcatctgaaaaagcaattttccaaaccccagttctctcagtatgtgaaagcttttttcatacttgccctccaatatctagctgacagagaaactactgatcaatacttgtcaatcatgcagctctgcactaaagaatatggagcaatttcctttaactctctacaccactgaagactcttggccattctgctgttctcagttcaaccagataactgggtttatattttacacacctgcactgacaccacaggtattttgttttgttttgttttgtttttttgagacacagtcttgttctgttgcccaggctggagtgccgtggcacaatctcggctcactgtagcctctgcctcccaggttcaagtgattctcctgccacagcctcccaacaagctgggattacaggtgggcaccaccacacctggctaatttttgtatttttagtagaaatggggtttcaccatgttggccaggctggtctcgaactcctgacctcagtgatctgtctgcctgcctcggcctcccaaagtgctgggattgtaggcataagccaccacacccagcccaccacaggtttttttttaacgggttcaagttgatgcttcagacctaagaaacaatggtagcatatagaacaggagaaatagcaggtacagaattgcaacttgggaaggcccagcctgcccaaacacatagctgcttttgccccctgacctagccagggcagctgtggctgccatgccagagagccaaggtcagggtgggtcacctagacacagaggagtcctagctctttttcccaccagtcactcacaccattccagtggcgggctcaagacctctatgctaattcacagctctccagtccagacacagccctccacgaatgataagatagcaacgacacccatcctaactctgtgctttcttttctctctctttttttttttttttttttttttttttgagacggagtttcactctgtcacccaggctggagtgcaggggcacagtcttggctcattgcaagctccacctcctgggttcaagtcattctcctgcctcagcctcctgagtagctgggactacaggcagatgccaccacatctggctaatttttgtatttttttattttttattttttattttttttttagtacagacagggtttcaccatgttggccaggctggtctcaaactcctgacctcaggtgatccacctgcctcggtctcccaaactggtgggattacaggcatgagccaccatacctggctctaactctgtactttccatggaaacagtgcagtgagaagagggaccccaaggtcactttctcagggaggtctagatcagcccgagcctgataacccttcctcattgtcttggtctgcttgggctgccctaacagaataccatagtctggtggcttaaacaataaacattctcacagttctaaaagctggaagtccaagatcagtgtgtccgtagggttgctttcttctgaggcttctcttcttggttttcagactgctgtcttcttgccgtgtcttcacttgatcttttctctgtgcaagagcatccccagtgtctgtccctcttcttacaagaacaccagttctattggattaggtctcacctttatggcctcatttaatgttaagtacttctttaaaggtcccatcttcaaatgcagtcacattggaggttagggattcaacagacaaattttgaggggacacagttcagtccatagcactcctgatacctctagtatcagatttatatacacatcatctcagccatatttaatttattccaactatgtgcttctatagaatgtgcctatactcaataatagcaataatcgtaacagctaccagtaactagaattagtgcaaagaagtgcattatctgttattaacacactcctacgcggtgcatattgttatgccaatgccacacataaggagactgaggcccaaataggacctgggaagctcacatgccatgagcggcgaagccaacacatagaagtagatctttgtgaccacagttcatgctttcttcatccctgcttgctgcctcccatacatcaaattgtgcctggcatcatcgtgcagctatttgtgatcaccttgggattaacctgcaggcaagaagcacgtcctcatcatcattttacaaatggctttcctgacgcctttcactcatgaactgatcatgcaacagctttgctcttctgagcatcctgcaaccgctctcatctcatgcctccttcccttccaacaggcctcccctacttgcaggatggtacccccttacctttttcctgaagccctctctccatggacgagctcatgatcccctttctgtcacttcctcagtggggcctatcctaaccaccctacttgaaattgcagcctcccccaccccactccaactctggatcccagctaaccctgcttgacttttttctccatagtggctaccaccttctaacacacagtatattttattttcttattgagtttgttgttaaatttctctttctgcctgcaagaatataagctctacaagaacagagacttttgtgtgttttgcttcaatactatgaagcagacaaacaaaacatctaaaacaaggcctggctcatagtaggcgtgaaataaatattttttgaatgaataaattagattttatgtgtgtgggctttagtgtgattccttctatggtgaattagtggccagtctctttgggcaaaagtactcaggaacccaacttagctctttattaagttctgaatttgaggacagtgtttttttttttataattcctcttgatcattgtttttgccctttttgtttaatttaatagccgattattttgtcccagtcttctgtgcattttacagttgtattattcattatgggtagttccagcattttcataattaatctttaattgcaatacttgcaaagcatttcacaagaaaaaatgatttacaaattaaacccacatctcaccttggataattatcacaggtctgactaatgtgcgtgaagcccttgcatggcagggggctctctacaatgacaatgtgttgattttctaattaacaaaggttaagtagcgtttttgcttgaagacctataatttaaacttatgacgtttgtcaccaagaaagatttctacagagcgcagaagtggaactcaaataattttcactgattctagtgcattaatgtcttttacataatatataatgaccgttttcaggacagaagatttttcttcatattgactagatcaggaaaagtaccttctagctcactgtcccatttaaataaatcagggactacctaagcaagaaaagagcctaatttatttagttttcctttatagagcgagaaatggcatttcactcacctgctttataaattatgaagagggaggacaaaactttttatttatttatttatttagagacagagtttctttcttttttgcccaggctggagtgcaatggcatgatctcggctcactgcaacctctgcctcccaggttcatgccattcttctgcctcagcctcccaagcagctgggattacaggtgcatgccaccacgcctggctaattttgtattttcagtagagaagggatttcaccatgctggccaggctggtctcaaactcctgacctcagatgatctgcccgccttggcctcccaaagtgctgggattacaggagtgagcaaaactttacttaatgaacacaacaaatacaaactagactacagtcatatgttacacccagttaaaagagggagaaaaaaaaaagtcagacatcggtgcaaagaaagaaaaagcaagcaaggaagagatttaatagaatttgagagtgtttactgaaattcagaaaaaaagacacaggcccagagggagagcctgtgaaccgtgagccagagtaattcagagctggaaggagtcacagacaccatctagttcagcctcctttatctgtggatggggaaaccgacgctgagagagactatgtaatttgatgaaagccacacaactgagtagaaatagttgatgatcctgagaaggaaagatccacaaacacaagtgcaggaagagagatggatccatgtagaacctaagaagtccaaagacccaagaatcaagacagaagcagagggagaaaactccgccccactaaatcctttctgaaatgaaccctgtatatataaataattaagtatccatgaatagatctaaatatctgccttaatgatataataaaaatatgatttactctagatttatttgctctgccaattgaccctttgaaaaatatctccattctcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaagccaaatgtccaacaatgatagactggattaagaaaatgtggcacatatacaccatggaatactacgcagccataaaaaatgatgatttcctgtcctttctagggacatggatgaagctggaaaccatcattctcagcaaactgttgcaaggacgaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacaagttaatgggtgcagcacaccaacaaggcacatgtatacatatgtaactaacctgcacgttgtgcacatgtaccctaaaacttaaagtataatttaaaaaaagaaaaatatctccattcttcatcatgttaacattcagagtcttttcaaactctcaatcattgctgaagatccatgaaataccaattgtttccaaattaaaatacatcccagatagacaaaaggttaacatgtggagagaagcaaaatcacaaacatgttagaagaaaatatggttgaataatcatattattttgtattgtagaaggtctttataagcctctgaccaaaggcaggaatcacacaaataagacaggtggatgtgactacaaaaacatgcaaaactttcatcgggaaaaagaaacaccatagagaagtcaaaagacacaaactggaaagatacagctgcaataaagagttatttataaccaagagttaaagctcatattgttattaatcaataagaaatatattctcttgtattcccagcaaaaagcgaagaacacaaagaaacaaaaaataagaaaagggaaaacattaaaattactcagctcacagtatttgaggtgatgcagatttaaacagtgaatcctttttgcccccgtcgagcagactggcatgaatacaaaaaggcactgaccaatattagaattgtgtggagaagatgaaaatctcataccctactggtgaattagaagttggtaaattcttcttagaagaaaacatatttaaagtgcctttaaaatgtatatgcccttcatcctagcaattagacttaaaagtatgattaactaattttaaagaatgaattctaaggaaaaactggacgacaagtgtgcaaaggttttcataaagattatattattatagtatcatataaaatggaaaattttaaaaacttaaaagtccactggtggtgcaagagcgaaataagtgatagtgcattcacagaataggatgctatgcagatactaagcaagatgttctcgttgtacatttattgcttggaaaatgttgcaaaggctgggcacggtggctcacacctgtaatcccagcactttgggaggccaaggcaggcagatcacgaggtcaggagttcgagaccagcctggttaacatggtgaaaccccatctctactaaaaatacaaaaattagctgggtgtggtggcgtgtgcctgtagtcccagctactggggaggctgaggcaagagaattgcttgaacccgggaggcggaggttgcagtgagctgagatcatgccactgcactccagcctaaacaatagagtgaaaatccgcctcaaaaaaaaaaagtttcatgatatgttaagtgcaaaaagcaagtttcaaaacaatgtgtatattatgattccatttcttcctttttatttacacatagtatgttcatagaaaaatgaaaaaggctgttccctaaaagtgaaagtagttaaatctgagtagcgtaacagaatctgttttgtattctgcttctcagtatgtttatagtgaccacaatgactattacattgatcaccaggcagaaagagatggggagatctaaaaatgatttctacattttagcatattttgatagaatataattgtcttaattgactagtgataaaaaatttttaaggccagacatttatttaataaaatgtcttttggaaagcccttattgcaaggacaaaagccataatggctaaaataatagaagccaaattgaaattctaacacacaaggtgtaactagagggttgaagttcttccaaatcaggcaaaggccctcattctcttcagcgtagaggtgtgaagcccagttgacaaacagatggcagaatgggaaatccttcaaagtagttgtttttaataacttcttttgccatctactctctcatagctttgatcaaaaaaggcactggactctcttcacttctctattccaatatgttagaagaaatcaaatactcccaagggagtcatgattaaaaccaatgagtcacccagtgagagaactgcaaggcttgggtttgcagagatggtacagcaactcatttgccacttcactgatggggttttgcaggcataagcagatgctaattcatctctgccactaaagcctttgatattccagtcctgtctgaccaatctactggagtttatgacttttcttaagataatagagtaagtgatcagaatcaatccccagcctactgatcttacctgaattccagtaaccctactgactactccatgtttaaagacctccaaatctacatctcagaaacatgtacatctatgagacccctgactggaaagttcttctcggtattaagtggtctacacagaacagggcttaagacaataaaccctgtttgttgccttaggaataagacagatctgatacagttgccactcaggaactatgagtccttgagtaaacttcttaacttctccaagcctcagtttctccatctgtacaatgggaataatgcaaataatatctactttgataagttgttgtgaggaccaggtgagtagcatatataaggtactgtatatagagtgcctagtatgtagccctcaatgaaggagaaacttgggttttatttttattaacagtattttcttttctaaatgctcatcacctatttctttcaacagttttacctactattcattttagattagtttccagaaaagttgttactctaagatgcaagcatgtatataaatttgagttcgtccttttataccagctgctttaaaaagattatagctaagaatactatagacacaattaaatccatttgtgatagaatgcctcaatgaatctttctgtgaaatttcttgggaatattttaatattttcatgctcatgaacctcagtccaactctataacttactccaaaaatcacagtgaacgtgcttattgtgctatatgtcgtgtaatgacatttagacaaaagcaatgaaatctgatctaacctagcaataaatgtggtatagctgatttctgtgtaaagttatcagttccagcttccagctaccccagacaaggagccttgggtagtcttgacatgaacttaaaagcaaagcctctcttgagacaagaaccaagatctacaatcacatttcaaacggatttatgtcttccaactaattgacttgttaactatgctaatacattcatgtctctgcctttatattttttcaataagtaatgctacagaactcgatgttgtgagattaaagagcaaagaatctagagatttctgtaaacgctttttctataggaaaccagattagacttccaaaacagctgatataatttttgtgcatctccaaatattttatttctgtaggaaacgtgttgcttctcagaagatggctcttttaattaggccttatagcctgcagggagaaaagcttcaactttctctatttagataggaccaacttgatagtgacaatactagatgtgctatgcagtgtcatctcctaccacagttgttcaaaatatgaagaattaagcaatagcagaggttattccctctgaactctgtgccttctgtcattcccaggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaaggtaaggtggaacccatttccagagccacttttgcgtgtctttttaagcccaaatcatctatttaatgatttttcatatgtaaacaagtgtaccttattctgaggttaagatgatcagaatttttctctcaacttaggtaggaattttccaaccaaaatcatttcctaatcatttttgtttgataaaatgagagaagctctgtgtatggtgcagaatttcttccagattctagcaaattattcactgcccgaaacactacaaaggcagtctcattacatcttaatggtgagtgataaaataggtggccttcaaaaggggaatcaggcctgaccctcccacgttaggatctccaatagatcaattgatcagtcaatttctgtagtgaatcagccagtgcaccccagtggtcttgatgcccccaccccctgcagttgctaagagactggattcaagctacactcaccagaaagctcctctggtcagtcattaacatcattattattactcttactcaggatgcctttgagtggctctcagcctaagctaaactgcagaaatgctgaaaaaccacatttaattggtcagcttagagcatctgttattacttggttattttagtcttgaataattcctttaatccccagtagattccgcagagccaatgagcagagtacaagagcccaatgcatatgcatgttatcatttgaactataccctgtgatcctgcttgaccagaagaagaaattgactcaactggtctgtggcttaatttcccatatataaatgagggatgaagagaggaggagctggtgcttttcctaagccacaattgaaatgcatgtaaatcactcctctctttctaaatgaatgtatagcatatgggtaaagttttctgtgagcggttggtgcatctcttaataagaagctttacataagtagcctgttcagactctgatgaatacatggagggttgtttacactggcattattcacacaagatgccacacacagaaggaggaattgttccataacattctctgtacctccaggctactgtttggcagcgctataatatgagcatacaaattaggccagacagggtatgaaaaatgagcatgagacaacaacaaaggtggaaaggaacaccattgcagaataataccaaagcacattaacagtgctattacagtgcatttttctgttcagaacaacatggttccatgattttcctgcggcacacaattgaatgggcctgcagaacacattaattttgcacttgtagaaatgacagtcttgcaattaccattcattgtgcttgatgctaatttaatgcagtcatttccttgccaaagtaatgtctgaatgcaatcaagtaagcactaatgcctgcgagattccactacataagtaccagtttaaagaaaatcaccatccctttatttttggagagttaggttaaacacagtagctcacgcaaaacctctggagattaataggcaatagtcatgaatagaaaggcaggggcatatcctctccaggttaggccacattgcagataaagtgaaatgacgcctgtgtgttgcctctgacattatttcaacatgtttacacaaaagacatctaaatatttccttattatctgtttagcagaatgagttttcatttgattcaattagtgactttaaccaaaaaatttaaatagaagactgcaaaacatatttggaaatcatttatgagcatccttctgagtcaagtacctccttgacttggtagaatgacagtggaactgtttcagaggaatcccacagctgtccaggaaagctttgtctgcactgaggcaagctccatcagggactggaaggatctcccagcctgatgctgtctctgctctggacctcactctccaggtagcctggtgcctgcacagcagttcctgtgaccgccccccacctcaggctggtgcttcagccaaacagctcagcctctacaaagagctttggcattggccgaagaatgagctccatgcaaggccttctctggccttcctttgggagtataggtctatgcttgcagatgtggaaaacatcgctaatattttgccaagtgaatgaagcaaggcccaacctaccacacacagccggactacgtgtttatacaaaataaaacatgcatacacgcagagatgaggcaaacaaactgtgagaatacacgccaaaatattaactgtggttattttttgcaggaggataaaaatactagtattttttcttattttattttgctttaagttctgcgatacatgtgcagaacatgcaggtttgttacataagcatacgtgtgccatggggtttgccgcacctatcaacccgtcatctaggttttaagccccatatacattaggtatttgtcctaatgctctctctccccttgccgccaaccccccaacagacccctgtgtgtgatgttcccctccctgtggccatgtgttctcactgttcagctaccaattatgagtgagaacatgtggtgtttggttttctgttcctgtgttagtttgctgagaatgatggcctgtagcttcatccatgaccctgcaaaagacatgaactcattctttttacagctgcatagtattccatgttgtatatgtgccacattttctttatccagtctatcattgatgggcatttgggatggttctaagtctttgctgtgtaaatagtgctgcaataaacatacatgtgcatgtttcttattttgtttttgcttagctacattttccagtctttgcacaatgatgtatttcctctaacatcattattttttcttctttggaaaaataatagtaggaagccaagttcttaccccagacatttgagggataactatctctggtcataaaatatctagctatttattagatattattggaccatctagttgtactttctggaatggagaagcatggtcaggtgaaaattttatgtaattatattgtccctgagaatctcaatacatttaacaatgcatttgttaaatctcaatacatttagcagaactcattttccacaagcagctgaagagatcacccttcagatgggcatcggaggaagggctgccttgttggggtcaggttgcatgaaaataaagacctcaagacactagtatcacactcagctatgtgagaggctcacactaggacaggcttgggacccaaaatagcccaggtcataaaatagcccagggggacagataagctaagtctcacccctgtatattattagcccatccaggagaatggtgggcagacagcccatactgtttgaattctgtttttccctcctctccttctccccctcctccccatcctccttatcatcctcctcttcttcccttctcttcctccttccttctccgttcaccataagcacaatctttatttctacatcaatccctgtctctgtctctgtctctccatattccatacctactttccctctctccctttcttttgctggagtgtatagttgaatatgtaagtgaaattaccgtgtcttgtcactttgttgaactaggaagacagggctggatttgagtaggttcctcatgatcatctcttctgctttgtagatgatgcactgatactcactattccgcactagtcaaaaccacacaagaaggggacttcctctaacctcttatccaaaacccttttttcttttctttctttctctttttttttttttttttttttttttttgagatggagtttctctcttgtcgcccagactggagtgcagtggcacaatcttggctcactgcaacctctgcctcctaggttcaagtgattcttctgcctcagcctcccgagtagctgggattacaggcacccatcaccacatccagctaattttttatttttagtacagacggtttcaacatgttggccaggctagtctcgaactcctgacctcaggtgatctgcctgcctcagcctcccaaagtgctgggattacaggcatgagccaccacacccagcccagagccctttttcaaagagatgcctaaagatttgaccaccagttaaagtgttagctctcccagggctacttgaatctttagtaggagtgctgactggggaatatttcatggtttggagatagcacaagggcgttgtggaaaccctacaactagaccatgcaggcagtctcctcatctgtcggcagataactgagcagcatcccatcttctcagcacgttcatcaatgaggagcagtttaactcagtggaggtaggtcccttccaatgcagaattccttggcaccccatcggctgaggctgaggggagaatcatcccagactacatggaaggtttaactgtgggtctgtcatccccaggattattggggaccgaatggatagttgcttggtcatgccaaagatagttttctaacattaaaactgctccttcttggagagtcagatcccaaaacactcaagaattctataattatcaatgtcacttttattactaaccagaaattagagacataatttgcagtacactctctgtgtgtcttctctgtgtgtttaagcaagagagaaaataacatacctatagtagaggcagcaatttctgtgtttacttttcgtggttgaatgccatagtagattgaatagtgtcccccaaaattcatgtccacctaggacttcagaatacaacgttgtttggaagtagggtccttgcagatgtgattatggtaagttgaggtcatactaggaggttggccctaaatccaatgactgtgtcttcataggaagaggagggggcacagaggtactgacagacatagaaggaaagccatgtgaagacggaggcagagatcggagttacactgccccaagccaaggaattcctgaggctaccagaggctagaagagtgaaggaaagattcttccctagagttttcgaagaagcgtagccctgagaacaccttgctttcagacttctggcttcctaggaaaataatacaagttcgaagaaaaacctaccatcttcttaattcttgctcttaacaaggatagcagctggtatttattgagaacttgtctgctaggcagtgtgctaagctttctaattgtgttagcatcgtttaatcctcaccacaacctggtgaaatgattgctattactagtgctcctattgtaccaagaaggagatggttgtagtagcctgccccaaggttcacatattagtaagaggcaagactccctttcctttcattttgtagcaactaaaagcatagcctctagtcttaaagctttttgattattgtgattgagtaaaaagaaattagaatattactggatgcagagtttatcataaaaaataggatacaagaattgaacagacactgtttttttttttttgctacatctaggtgtaaggtttattcatttattgactcttattgagcaaacattcattgaacacctaatgtgcccagaagtcttgaatgtatagttgaatctgactacactgaaatttccaaagcattttaatggtttacagatacaaaatcaggcaagtctagaatatatgataggaatacatgtgaattggatatcacccaggctgctgaaaacagttcttcattatgatcctttcaccaagccaagttaagcaagaacttatcatcaagagacacaaagatatctccaaattcactcatctgcactttttttaactataaaaatgttcatgttcatatgccaaaccaggactgcagttgaaaaatacatttctttaatcactctgaaaccattttctgagttagggagttctgttttcttctcaaacattcatttgtttattgcttagaaaaaacttgaagaataaaagtcacaggattactgagtgaccaagatttgaatagtcattcaatcattgcagtgtttccatcatttacagtcacacaaataatgtgccaccctccctgtgttccagctaagtctcctattctccctatgagtattgtgaagttagctaatattttataatctgtattattaagatggtagaagaaattgtttatagcaaattcaagtctcaacctataagatgatgatggaattagatgtcagtttgaatccatctttctcacatacctgttacgtaaccttaggaaaattgtttgtcactgagccttatcttcaggaatacatagtaactacctcttaaggataccttgaaaatcacacagaataatgtgaatgaatttccacatgaaggacctggcacacagcagtccaacagcaaatgtccttttcattcttagcagctctttgctttttggtttgtgtttttgtttttacttaattcatgttgtcctttaatccttccctaatagctttaaatgtcaaatgcctaactggcattatttcggtgatccttgagtattggattgtcatttcggtacttcaggagcagtggcagtgtcctaaaatgtcatttctacttaattttggtcacagtaaaagtattctgaagccctgaagggctgagaagtatgcagagattctggaagatgcaactggaaaccacacccaccatatcggactggttttgtcaatagcgcaagtcttggagcaatgtatccagtcctttcaagaaccaagttgggtcaccttagtaactcctgcatcccttcctgactcaaggcccatcaggagacaagaaagcgctgattagccaggcacactggctcacacctgaatcccagcactctgagaggccaaggtgggaagatcatgtgagcccaggagttcaagaccagcctgggcaacatagtgagaacttgtctctacagaaagacaaaattagccaggtgtggtggcacatacctgcagtcccagctacttgggaggctgagatgggaggattgcttgagctcaggaggtcaaggcttcaatcagccgagattgtgccactgcactttagcctgggcaacagagcaagactgaggaaagaaagacagagggagagagggagagagagggagtgagagagggagagagggagagagagggagagaggcggggtgcgggggagagagagggagggagggaaggagggaaggaaggaaggaaggagagaaagagagaaagagtgagaaagagagagaacaagagagagaagagaaagaaagggaaagaaagaaaagggaggagaaagagggagagaaagaaggaggaggagagaaggaaggaaggagagagagagaagcagagaaagagaagaaaagaaaagaaaggtcccagactcctttttgctccaagagacctcaggctcaagtccacgttatacctctaaggaagagagggttttccacttgcctcctagagaaacatttcttgttggatgtgaggtagtgggtttgccaaaagcggttggaagactgaacaaattctgttccacagctctcagtatgaaacagggaccagaataaatgcatggtctacccttttagagcaggttggagagaaaattaattaatacaaaatatataaacaaatagggagaaaaagaagagaaatgttggaagtatgcatcttagaatttcacccctatgtgaaatcagctaagctgttagtgacaatggccatttttcctcaggtctacctatccagtcttaataatcccagcttggaagacactttcacatcagtagggagagaaacttttcacaggcttctttttcattttcagttggaacaggaggtttgacagatttggaagaaggcccaaaggaacaagaatagaaccctttttttttcttttcttcttagagaattattcaagtagagaaaatatcccttctctcttaatgtatttcttaaatcttcagaccttaggatgcaatttaaaagtatcatggtaactgtgatggttaattttaagtgtcaacttgactggtgttccatagggagcaggtctatgcaagcctacctccaaaggccaagggagctgagaggccaaagaaacagtctgacaaagccagtttctcagaagaaaaaaaaaacaaattgaatagggacttaccaacagaagttgcgtctctggtatctacaagatgagatggtggattcctttacctcctcagacccagggcctatataccatagagaaagggtctacatgcttcagaagcaagttaccctagagcagaatttgcagtaaacagtagataaggtggaaaacttagtggcattctgcaactgggttattcagaagccagcatggtgcattagcatccaagaaggaggtgctttagcccctacacctagaaatctgtaaagcattactttgaggtgggtctgtgaggctgtttccagagaacattagcatgtgggtctgagtggatgaggtggggaagagctaccctcaatgtgggaaggcattatcctgtctgctaggggctgcagagaacaaaaacagagaaaaggtggtagtgtctatctatctactagagatgagatatactgttttggggcaactccaggctccctagcctttgggctccagaacttataccagattctcatgcttttgagcttgggctaagagttacaccattggcttcttttgttctgaggcctttggacttggacggagccacaccactggtaccccagggtctccaccatgtagaggacgtatcatgggacttctcagcctccacaattacatgagccaattcccctaagaaatcccctctcgtatgtctatatctatatagtctgttgattatgtccctctagagagaaccctaataccataacgcatgaaaataatctgattaaaagcttaaaaaataaagagagaaggaagagccaaaaagtcagaaaatatttatggatgaaaatccataagtggacagaagtccacaaatatgtatggaaaaagaaaataattttgacttaattcagaaaagtcaaagctgcagagatagctgccaagtttaagtggctttgttatagaattttgtggtggtaaaataacattccccctagcctgaggttctctttggggtcccagatatttgagaaaacctggccaattaactttcttagagaaagagatttaaaaattcagtgcagaaaaagcaagtcctccgtaaactgttctaaatctaatacaggacaaagtgttcggatttggctttggttgtaggataaataacttttgtttcaagtgtgtgcccttttttttttttttttttttttttttttttttttgagacggagtctcgcactgtcacccaggctggagttcagtggcacaaactcggctcactgcaagctccaactcccgggttcacgccattctcctgcctcagcctcccgagtagctgggactacaggcgcctgccaccacaccaggctaaatttttgtatttttagtagagacggggtttcaccatgttggccaggatggtctcgatctcctgacctcgtgatccgcccgcctcagcctcccaaagtgctgggattacaggcgtgagccaccgcgcctggccaagtgtgtgcccttttctaatccccaccagtgtggggacacagctgaattttttttcctgagtgttttatttgtatatgttgttgagtgtttttatttcctgttcttcagcaatgatcagaactctaaataatgtgaagttcacagaaataacactctttatcttttcccacatattagctccatgacttgagctgaaactctatacatttcttttcttttcttttgtgagccaaaaaggaactggtctgataaattgtcctgagggttttgcttttagattgctcacatgtttggctgccctgcaagcaggtccattcaccaacgtccacgctgcccttgagtactccatcacgtctatgggccatgaagacctgcctctgacatgcaatttcttcactccacaaccatttgcgcgcttatcatttccaacaggcagctctggccttagcaactgggctcattccaggcattccttggctacaggaaatttactttcttaaataatcaagcctgagactataatgctatagcctacccattttatagatcaacctggctttgaactcactcacatatttttacctctattaattccaactggttacaagagtgtttgatttagataaataggcattttatatttttctgtttaaaaccaaatcctgagaaaacaaattatgaagagccagctgctctctctgagccatccttttcttggcattttaaatgtattaccttcattttctcaagaggactgggcacaggatatagtgaaatgtttaacttgactaacaatactttctagctactcttccaagggatatgtttactaaatataaggtggcttttacagtattcaagttctataaggcaaagactctcaattaaattaaattattggcagtacaatttaacattctacattctgtgtgaacgaagtaatttcaagcagtttgatcattaataataattttattccttcctatacactgagcacaagtttagtgaaatacgggaacatgtacagagagcctgctgtgggggaagcagtggattgccagcaaggaaggacaggatgaataagactaggctgggaatgcaatggaggggatagaaccaactgcagcatgcagggaaacaagccagaaggccgagtgagagacccccatggatacccacgctgaaggttctactgggagggctgcctgattcaaagtcttgtccaaggacagcatggcagatagtggtgggttgcacctaattctgagggcgtaatttgggttaagggagaagactctttggaaaacatatatcattaaagcctaaagtctaaagacaaaagttttaaagcatctcaatttttttaaaattgtctttgaaataatacaattgatatttacaagaaatacttatttgctttttttttttttttttttttttgagacaggctttgagctttgttgccctagctggagcgcagtggtgcaatgatggctcactgcatcctcgacctcctgggctcaagtgatcctcccaccttggcccccagagtagctgggactataggcatgtgctaccataccctgctaagtttttaattttttgtagaaacagggtctcactgtgttgcccaggctggtctcaaactcctggcatcagggtatgctcccacctcagcctcccaaagagctgggattacagtcatgagccaccatgcccagcctacttatttgcttttaatattacaaaattgaattgctttagacattaatagtggacaaaatattttaggagttagattagcttaactatttttcaaattatattccaccagccaaaaatatttcatgaggctttgccttctttaatttctaatatgaaaacagtagggaattttttccatttttcaaaaagttattctaataattaatatgattttctcaaaatacacgtctccttgcagttttttcccttactcccacctccagataattttatatgaacctagtggacaccttccccttgagtatttctgccttaaagataactttaaagatacaacttcaaagatagatcaacaaattgatatgtaaaccaggcacggtggctcatgcctgttaattccagcattttgggaggctgaggcaggattgcttgagcccaagagtttgagaccagcttgggttacacagtgagaccccatctctataaaaaaaataaatatctaaaaataaattgacatgtaaataagtttatctttgctttttgttaaaagaggtcttctaaaaacttgcttttatcaactttaacattactaaattttattttagtattctgaagtttagaccttaactaatgcaaatttgcttactttagactagtacaaatgacttatgatttacctgtgccagtagccaatctcactttctgtgcttctccctagggagttgggtcaagtatagcttacagagaaataccaaattctagcccttatgtgaatcatttctcagcaatcctcaaaggcaccaaaatgtcctttcacatcttctatttctttccatcctggatttatgaccagaaacacagacaacactattctaaactaattttgtttaaagaaaggggaaatttgtactttttgagtttatcccaattaaagagggaatcttatattatatagaacagtggaacaagagtaacttgaattccaatttcaacattattaaaaaccaaagtgaacaatcctaactaggcattctgtttctttataaattgcactaattatataaaattcattattcacaaggctgtgaggatcaaatgagctgatggatgtgaaagtgctttgaaaagcattaatgttataaaatgcaaattattattaagtttattaatcattgagtcactgaaagcctctttagtgagaatcctgcaaaatgtaaaccattatctttcaagagctgctaggaaatcctagacagaacttttctatctgtgttgttagtgttgccataaccaacagcaaaacttttccctctcaattgttgacattagtgctcgcccgtctctctgtacagcactgaaatgcgttatccagaagctccgtgctcacaacaatccagcaagactttagacctcagagttatactagttcatgacaggcagtactgtattcatagtcagccaacccttgaatgcatggccctgattaaattcctgtctctgtcatggaattggcatgagtcatttggcctggaacatcattaaagcagcaaacacacttgagattaaataagaatggattctaaaacatcctcttgaggttgttattgagatcgttagcaaatcatgttggttccttgagtatcttatagagtttcaagaaataaaaagcaactgctacattgtagaaagtacatctaaaattttcctcttatcccaagtgattgacagtctctctgcatcctctgccccgttaccaaggatgataactcctgttcagatgaatgagtccagatttttctcaggtctaagccaaatgtaacccaaatatttgaacaagtccattgctagtcactttttagttttcagagatgaataaagctataagtaaaatgctttctaaagctttactattgaagtaatttgatttaaatcccttttaaataggtctattttagcctgttgacttttatatttccttaacaaatgtctcttataaaggaatcttgtaaattcagttaaaaatataaattaagtcatgtaagtcaaattaaagcagtagatcaagttataaattgaaacaagtttataatccctctcctctattaactaagttaaaatgttatcttctgtggcctcatacaacaacctcctgaatcataaaccacctgaggttatgacaaacacttaataacttcttttaaaatatcaaggactattccaaaagacttttatttctgttactataatgaatttatgattactcagactttcagcttttgcgctaacattcaaatgtcattgggttacttattccaacacttcttctattactatagatggttaaaagttcaggaggccccttttgtcacaaaatcaaagtatgtcgtggttgaaaggactatttcattcattcatattcaactgatattttattaaacatttcctgttatgccaggcactgaactaagtgtgttcacatagtttaccttatttaatcatcacaacaacattcaggcattgatatgatcacctttatttacaaaatgaagaaacagagacttctagaggttaagtttatcatccaaaatcacattgctagtaaatggcagattgagattggaatcctaggtccctgactccaagcctagtgttttttccaccatatacactagaatgatgtcctctttataacacactcactggatcagatccaagttgtgttcatggagagcccgggaccacatgaggcagccctcttcctatttgagcatttcagacaactggaaagatttccctcatcctgaaccatcatctctattaaagatggagaatgtctccatgaagaaacagtgggtgtctggctctgggttcaaattcctgtgcctgtaagaactcagaaacacctatgcaccttcaaaatccccaactctgtggagataaggaagagcacctggcctaagtttgacacaaaaggggtatttaatagctgattcattccttactcttctgtttcctttaccaaagtctcaatggcccttaaaactaatatgctgacacacggtcagtggtccaatttgctatggctattctcccaatgccccaggaggccttgaaagatattggccttgcttgttgtccaatgtagaatggtaaattaatgagatccttggataccagataacacagcttgccctgtgtgtcctctttctatcttatcaccctgatgactcagggcaggcctaagtcctaaaagttctgaagaagtttcccttctttctttgccgttctttctgaggccctctctgtgcggttgagcaaggaaacatacacacacacacacacacacacacacacacacacacacaaacagagccaggtgtgagctggacctgtcggtttctaacaataagtcttagataacaagataattctttgtgtttcttagggtgccacccacacaccgtatccatgcttttgtgttaatagcagagacttctctttctgaatatatgaggagaggaataaaacaagggatgtgaccaaataaattcttctgacatgagagaccactttagattgccttattacaaagaagctgatttgcagggtaaacacaggccatgccctgtaagttttcttattgatgaaattcatgctttgaattactgattgatggttgctgaaggatggcaatttctctgttccagtctggagactgcgctacgtaaaacgagcttctgatgatggaaattctaaaatccaaacaaaacatggaaacaattttttaaaactcgacatctatttctatgaggagctaggagggtggatgcaattggtcagctccagctgtttccttgcttttattgcacagttgttacaaagaggaattcagtgtacaactatgagcttccggccgctcaagctactgcattacactacatggccatactctgatcccaacatgagctttttttcctctagccaaaggataatgtaaaaattatgacacaaataaaatatttatcctctaggcatgagtaaaggaattcacaaatcagaacatagcttgcaagcatacaagagtatgcttgagcagtcccctctttttaataaaaatcaaccatatgaataaaaagctgccctgccccaacttcaccccctacccatcacagaccacaccaccaccccaccatccccgcatacatgcgtgcacacacatgcacacacacacacacaaagccacccactaccattgcagcagggaatcactgatttttttaaattaaacttttagagaacccatgagtttagatggaaaaaatcgtgggagagtaggaatagtttaaggaatgtgcttggagaccagccactcttcacccaaaatgatttcctttgaaattcctgacttgttccctttctgtcctgtgacctattgttctattaggccattctattctattacagcatcatttgaatcagtaggagtgggtctgggaggatggtaataccatctctttaatacctcaatgtggacggaattgaaatggccaagtccttacccagaagagctgtcctgaagaaggagcattgagtttgaagggaggagccaggtgtaatttaggagtggggaagacattggacaagctttgaggagatagttaagatgacttccatgaaaacagagagctgaagcctgttagtaacagactggaaggaagaaagatactcctttctttgctgatcttgcctaaagccagcaggtctgcactggcaaaaagagaggaaactgtctttctctcccctctggcagtttctcttctactaagatccagaatccaagctaatggcattagtgctataatttggtttcactactaaataatctttagttattgatccatgttagaattttgtactattggaaaatgtattctgagttcctaaaatcaatttatattattataatgtatgtaccgtactatcattatgtacatagtattagcatatatagcatttcattcccttgaaaccacttggtcttcatacccatcacttaaaaatactgcttcatattattccacccagtgggtttaccaaaatttatttaacctaaatatttcacaatagggaaatggcaatttcaatttctgttcttaaaattgtttccaatttttttattgtaaataatactgcagtaaatgatttttgcaagtggcatttcaatattttacattatttattgaggatggattgccagatatggagaggtagagttagaggatgtaaaatgcttaggcttttcacgtacaaagctagtaagattttctaaacacagtgccaaagtacatgcagtatacactgagaatgccttgttctctgaacactaccagcaatgtttttcttttttttatttttatgaagataataagctaaaatggtaacctatttgcctttacttcctccaaaatccctagaaaaggatttcaaaatttttttgaaggtaagagtcaatctaaacaaagaggacaggagaggacagcaacatttagaaagacggcaagcaaatggaggaataacacacttagtagacaaagggaggccaacccctaagctggttgagggagaagctcaagagcaggcaattataaaagggcagttccttttataaggaaccgactcctgcaattactgccttaactcattcatgaaggtggaaccctctgggtcaggctctggtgagggccctcttctgggtggcagaagctcaagggcatggctcctcttctctttgcccttctgccatgggatgatacaacaagagggctctcacaagacgacatcccctcgatcttgaactttccagtctccagaaccacagccaagacatttctgttcattgtaaattatctgcggtattctattatagcagcacaaaatggactgagacaggctgctatagcggactgccatagcagtctctgttgcactagaaggctcagaaatgggtagcccctggcacctcagaaagatagacttaaaaacggaaggatcagctaaaaatttctatatgaagacaatcttctcctcactcttgcagctgggtaactgccccagagccaaataaggcagaagacccaagatttagtgtctggaggggcttcttttatctcttgaagatttggaagattgtgttttccaaggacggctgccacaaaagctctcctgacacctgtgcttccagagccaagtgactgctccatcaagacgtgatatctagttttcctctccaagaatctggacagccttgggacttgcttaagccaacagaatgtggcagaaattatgctgcctgacttccaaagctaggttatagagccaaggtgacacgtgccttggggactgggccatgcacattggagtactgattgcccaggaaagcagtcaactgccctgaggccaccatgctcaaggaactgcactaggttacgtggatcggacacatgaaaaagctttgagatgacctaaggaggtagagagaggccaaatttctgattcacagaaaccattagagataatgaaataattgttgttgttttaaaccagcaagtttggggagcaatctgttaggtagcaataaggactggaacagagaagatgaataatagttttttggttttccaaaagaacttactctccaagtattatctttgtttttgctaaatcctttgtattagtctaggctcttagagcgacagaatcaagaggagatatgtacctatatctgtatctctatatatgaaaggagatttatttggggaattggcacatgcaattatggcagaagtcccacaatcggccgtctgcaacctggagaaccagggaagccagcagcatggctcagtccaagtcttaaggccacagaactagggaagccgatggtgtagctctcagtgggaggctggagccctcagacaccgggcggccactggtacaagttctgtagtacaaatactggagaacccagagttctgatgccaagggcaggagatgtcccagccctaggggaaagacagagagagagagagagagagagagagagcaaaaaaagaaaaatagaagaaaaaacatgcattcaaatcattttgtaactcctaattattaggacgataataaaagaagattccagattccagacctagagagcaaccagtacagactgaacaaggaagatgaagagctccatggggactatctttgtctttagtctctttgggctgtgctaaggattgaatgtgtcccccaaaaagcatgcactagaaatgtaatcttcaatgcagaagtgttgggaggtgaggcctaatgggagatgtttaggtcgtgaggactccaccctcatgaatggattaatgctgtaattgcaggagtcaattccttataaaagaacaagtctggtccccttttgtgcactcttgctctctctctctctctctccctctcctctttcctctgtcttctccctctctctgtgtcctcttctctttgtccttctgccatgggatgttcaacaagaaggctctcacaagatgccatcctcttgatcttgagcttcccagctagcttccagaaccatagtcatatatttctgttcattatacattatctgcagtattctgtgatagcagcgccaaatagactgggacaggttgctatagcatactgccatagactgggtggcttccaaaacaaacattgatttctcacatttctagaggctggcagtctgagatcagtgttccagcatggtcaggtgctggtgagggccctcttctggattgcaggctgctgacttactgttgtttcttcatatggcagaaggagagttcagagagctctctgggtctcttttataaggggactaaacccattcacaggggctccaccctcatgtcttaatcactttccaaggcctcacctcctcctaccatcaagttaggggttaggatttcaacatgtgagttttgatgggagacaaaaacatctggtccataacagtcaagaaaaatataaaacagtttacttctgtttccttccagtggtgagataagggatgagttagtgatgagtgtgcagaaaacaaggcaaatgaagaaacaaaagattgcactggaatgtaaatgcaagtgttttacaacatatatgatcaagaacaatgcaagcttgttacttagaaatatgaagttgatgccaaaaataagatggcttctgaggagtgggaagtggggaggtggagtggagacttccgttaatgtgtttcagggcttacagaagcacttgagtcctttcttaaaaatgtgtaaatttatggcgtacaagggtaattttgttgcatgcatggattacatagtggtgaagtcagagcttctaaggtctccatcactcaaacaaaatacattaaataaactctcgtcatccacccctacacccttctgagtctccacactctatgtccatgtggacccattgtttagctcgcacttataaatgagaatatgcagtatttgtctgtctcggtctgacttgtttaacttaaagtccttagactatgtatgtcacaacattcataaaaactgatcaacttaaataccacattaaaatgattacagaaaaacgcaagcaaaaatataataaagtaattttttcccctccctcaaagccaactgataacgaaaagaaagaaatggatgaccaaaaaaaaaaacaaaaaacaaaaaaactctccatgcagtgagccgagatcacgccattgcactccagcctgggctacaagagcaaaactccgtctcaaaaaataaaaaacctccaataaaatatggcaatgctcattgccacaaaccacaaattaggaaggatacgtgacacatgccaactactttgaaatttgcatcagaatgagagaggaggcagttaattcatgttttcttaacttcactcaaagttcagcaattcctttagctctatttcagtttcttcatcctattgctttcttatgaaatatgactttatttttttcctataaaagtagcagaaatgattgaaagttctttgcattttttggcggtgtttgaatttttaataagggccacatgtgtctttctaaaaattaacctattctctttttaaaaattaacaaataaaaacttgttctctttttaaaaattaacttatttgttctctttttaaaaaatgaagatttttttcctcaaaatgaatatacttttgaggtaagaggattttcacctagtattctaaaatcacaaaaacaagtttattatttttattttattgcaaatatttttcctacatggttattttcagatcaaataataggattttggaaataccagcctgaccatactgcacagattgagaggttaggtactaaattataggcttttagagggaggtaaagatattagagtccatctccactccactccccacagataagggccaaggccaacctagccattaggtggggtggacacaacccacgttttgaggggcccacacatatatgttaaaatttctttagaaatcagaagaatacaaatgaacttcggggtcaaagaaaatattttaatatttaacattaatacattttctcttgaggccaacattgtcatgaaatacacattttcataatttttttttgtggaagaaagggaccacaagggcaagtgtgcctggggcccatgaaagtcataatgtggccctgatgaggattctgggacctaaaaagattcctgtaattggtggtggcagagtctggaccaaagctcagggcctctaactcctcctctatggtgctttctgccatgctgttctctggcttgggtattccacacactccatggtccagcccacactccttatctgaccttacctctggccatcagtcatagttcatcttctgctccagttaggtaggcccagcctcatttcctgtaattcatcacaaacactctccatcccagctccatggagcctcccattgttcctagtccactgctgttcattcccagcactggctctcactcctcccactctccccatgtggagaatccttcccgtttccttctgcttgttcaagaggatcctcatctctggagactttgtcttaacactgcctttttttttttttaactgaaacagggtcttgctctgtcgcccaggctgcagtgcagtggcgcaatcagggccaactgcagccttgacttcctgggctcagatgatcctcctgcctcagcctctcaagcagctgggattacaggtgcatgccaccatgcctggctagtgtgtgtgtgtgtgtgtgtgtgtgtgtacatatttttttttgtagagacggggtttcaccatatggcccaggctggtctcaaagttctgggttcaagcaatccacctgctttggtccccaaagtgttgagattacaggcatgacccaacactcctggcctctttcaagtacctttaaagactcctccagccttgagtgatctaccctatgtataaaagcatttgccatttagtaacaaattatcttttcttattcatatttgtcttatatgtcttagttttctttccccaattatcttgtcaggtccttaagctcagaagcgatattagtcaaggttccccagagaaaaagaaccagtaggataagtataatatagataagagggaatttattattggaagtgacttatgcaattatggaggccaagacagtctatgatatgccatctgtgagctggaggcccaggaaagcccatggtgtaattcagtctgagtctgaaggcctgggaacagggagccagtgtgtaacctccagtccaagacgagaggcctaagaactgaaggaagtggggtgggcggagtcccagggcatgagaagaaggatgtcccagctcaagaaaaaaaagagacaacttacccttccttcacctttttgttccatctggcccctcaatggattggatggtgcccacccttattggtgagggcagatctactatactcagcctactggattgaatactaatttatggcaacaccctcacagacacaccccaaaattatgttttaccagttatctgggcacccttagcccagtcaagatgacacatgatattaaccatcacagaagccatgtctcatatactcactgagcatatatatgatcagcactcagtcaacacccaaatgattgtcagaaatctctcacaactccccctacaataatagggtcaagtgctacctcttctgggtgtcagaaataggcttggctttcctttctctttcttgtatttgtaccctctgtgatgaaagtcacgctgtctgattgcacattccttctgggcaagggctgatgtcttctcattatgtattgtcagtctccagcacagtctgtgctacaaagtaggtgtttggtaagtatttgatgaatgagcattttctagaaccaacttttaaattgaatttcttggtcctggagatgtttatttttcatgtgagttttccatctctgaaaaaaataggaaaagaaaagacaaggaaatgagaaagcaacttgaaaacaggaaaatattggtgaaagttattttcacagaagtcttagttgacctttctctgtagcattaaattccttccctgtagtattaaattcacaacctaagctatagctagctttccaaactagacaagcatcccacttaagcacaattgatctcatttcagtttgtgtctttgggcaatgaaataccgcaaagactttttctacctatgctttgatgctttttaaaaagtattttctaaatatttttaaaatgtttgaaatacacaatgataggataactccaaagctgtcatatttgtcaaataattcaagtcagaatttaatatatcctataactgagactcttttataaaattgagacaggcacctgaagaccatttttatttctgtattttcttggtgtcccaagcaaccccctttagagaaatcactaatatttcctgagcaattgaaccacaataaagaccgtggaaagaaaaaaaatgggtctgctcagacattcagagcacgcatccttacaaatgcattctactgacctgcaaaatgttagtgggaatttataaatgcctacaaaaagaatatccaagtcaacatttgacctgtcaaatctaatcagtttggttttgatcattgtaccgggttgctattcgcaaacactaattgaaagcaaaaacacaaacagcatttttaaagagtttctaggagaatatcccatttgcacacacgtcagattaattttccccagagttgagcaatttcaggatcaattgattactgatcccaaggaacaatcaaaaaagaaattccctgaaaaatttttttgactgtcaagactcagcatgggaaactatgccatgaaaatgcagtttgaatagcttgtcttttaatcccaagtgaaataaatcaatcatctattagacttttctagttccttgtgtagtcagggatagaagagttcgctgcagcaggattcggaggaactggggggatctgggtccaggaactcgtctgatcactagaatggggcagggagtgagcagaggagtttgcagcacacagtagaggaagctggtaggcacagaatagtaactggcaggcttacagctgggaccagaggggtccagcaatgataacagctcccggcactttctaagtgtattaattaactcatttattcacacaagaatccaataagggagatagttttaatagacccattttactaacatgaaaactgaggcattgataaattaagtagcttgctcaaagtgacccatctctttggcagagcaaggatttgaacatagacaattttgctctaacacctgtgcccttaaccactgacttgtaactgttccagggagaagatgagcctcttttgggcagcagggcagtggacagccactgaaaatgtgagagctggcaatattcaaagaggcacattgagatccttccaggaaagtctaactgcttgcaccagggtccaggctcaagggagggattcagggagcagcccctagaagtaagtgctttcacttgctaggcagtgcttccctgactcttaggctgcaaatttctaaaaggaaaaaaaacaatgttaaacacgagtgccagtttatatacctttatatattcagttatacattttgtaaatatattacagaattaatgtacatcataaaatacacacaaagggaaaaaaatcattcctttacatcaacaacctactataaatttacttcaaatagcattcatcagtactagcactagaaatgtgtgtccctgacgaaaaatatgtttttacataatttagatcttttattttgaaatttatcagaaatttcttgattagaacccagttttcctagaattattccctacttgttagattatttatccacatatagatgattccgtgaaaaaatgcaaagcaagacccttgatatattgtgtaatcctgaaactatatattaaaaacaaaatagtcttttagaaagcctgcagcagtaccccaaaataaaggtcacccaagaagaaaaattctccctagaataatgcctttaaatcccggaaacgaaagctcaagtgtttacccgttctttttaacattttcagagcaatacaacagagtcaatgtatgaaataaggcattggagttcagtgtaagctaccaccaatgacagaacatgtccattcagggcaaagatttatttttctgattataccaatgacccacacatacacaaagaaaaattaaattgaattaaaagaaagcatttcagcaatcttgacaggcttgagccctctgacagctcctagaattctatcagccgatcatcatcgtgttgctaaagccagctgcctcttgaaaccaaatttaatggaaagaggaggagctcaacaaagcagcttaaacatctcaccttcaaagctcattgaaaactaggcttcctatcagtcatgtgtcaaaggttcccctcatcctacaccatacagattagttcttcaagttccatttgtgtggtcatcctttgagtttccttgaagctctaaaaaggctaaaaggttatttccatctggagccactggagccttaatccatgtatcttttccctgcgcgaatctcaacatggcggaactggaaagtgagactcccaacttccatgtgaagggaacgatgtcaggcaggctgagaagcctgagggtggctggttccaaagggactgacccaagcctgtagcgagcaaggaggctgcctgctacccagagccaccaccccccatggcagcagatcacagcccctgttctttctcttttgaagcttcaggttagggatgggcaattcatagcaatttgtctttgaggtgataggtttggcaaaggggcatgatccaagaagtaagaaatgtgtgagaagtttcataaaggttgatggcgattgtgaccatgtgacctgtgcaatctttaactcatcgagtatctaatgtagattcttaactgccttgagtgcttttaagggactccttctgtgggggcttcatggggatttttcctaatggttaagctatgtaaatgtcttccacagctcctgtaaaatctcccatgctgaaataactacatccctgctctacagctatgaggattgtgaccgtatgtgtcccagcaagtggtagccaccatcataagctttggaggacactgtgttcttctagatactccctgggccatcttttcagatgtgccctttcagaagtggtcgccctttcagatatgtccttgtcttagcagttggttaaagcttcataggatatttgtattcaaggtgctagttcaaaaacatgaccttgaattcatagctgcgaagctcaactgagagaaaacatatttaggaggatggaatccacgcattgccgtagaaaactccttctcaccctggtggatacaacttttgaaaaatattgatacctgggccccatctagaaattagtctcatgtgggtgctcagagaacatagggaggtcattggggatggagtagaatgagcaaagaagagaagaaaatagggtgagagaaacaatggggtgtggaatggggagaagaggtgcagattagggagggcatggcaggccatggtaagggcttggcttttgcccagagggaggtggagttcatagagggttttgagcaaaggagtaacatgatatgacatatattataaaatgatcactctggctaaattaattccttttgccattgcatccttaaaataaacctaaaaatgcagaaaaactgaaaacaggaaatgattttccaagctgctactcaaatgtctaataacaagaagtgactagaatcctaaatcccagaatggtccacgtattatctccccagattcctgatagagatatgtagaaggcacatttcaagcaggcttatattgttttattctaagagggctgaactgggaatgtgaggtttcaagtccttctttgcttaggtgtatccagaggtaatacccagaaactcaaatttagtggtttgagatagactgtagacatcctgttgttaaaatgattccaatgcccatgtcgaaaacacgtctccaaaggctggaaaaatcaactgacattgacaaatgcttttagttttcctttcttggactctatatagctgtactgtctatacagtaaccacaagctacatgtggaggttgggcacttgaaacggggctagttcaaattgagattgtgctataagcataaaacactcagtagattttaaagacttagcatgaaacaataggtttatgtgttagtcaaggttctccaaagaaattgaaccagtaggatagagagagatacataagagggggtttcttaatggaaattggctcatgttattatagaggccaagaagtcccatcatatcccatctgcaagctggagaaccaggaaagccactggtataattcagtctgagcccaaaggcttcagaaccagggggacaactggtgtgagtcctggagtccaaaggctggagagctagaagcaccaacatctgagggcagaagaagacggatgtcccagcacaagagagggtgaattccccttcttctgcctttttattctttccaggtgctcaatggattgggtgatgcccactgacaattatgatcctctctattcagtcgactgactgagatgctaatctcctccaggaatgccctcatagacacactcagaaatcatgttttatcagccatgtgggcatctctcaggccagccacattgacacacgaaattaaccatcacaatgtaaaatgtctcaataatttttacatagattacatgttgataaaatattagatatactaaattaaatacaacatattattaaaattcatttcacttttttactttttaaatgtggctacaaaagaattaaaattacaaatgtgggtcccattacacttcttttctttctttctctctctttttttttttttaaagacctctgtctcccaggctagagtgcagtggcacaatcatggctcactggagcttcgaactcctgggctcaagcaatcctcccttcctagcctcctgagtagcagggattacaggcatgcaccaccaggcctggctttcacattatatttctactggacaggactgatgtagagcttttcaaagactcctcttacataggaatcatagccctctatgataaccttcaaaatacacctacgatgctaccattctccgcagtaatttttttaaagaaaaatgctaaattgcttttttagatctttcttgtaggcaagatataaatagaaggctttgaaaggcaatacaacatagtagttaatagtaagaacttggtagatgtgtgactgcaggcaggttgtttaccttctctgaatctccattccctcgcctgtagaatttgaataatatgtaccccatggtgttgtgagactaaataacatagtccttaatgctccataaatggtagagcctttgtaattggtgctgaaatttaaagacaatgtggagttatcttggattcaggtgatgagattcaacataagaagcaatgcctcaagtccttgcaccaacagaggtgcagaaattcatcatctccctaatgaatcttgagttttctttatacttctgtcatttgattagaaacaaactctcagcatgtcagatttatattcaaatctcagaataaaaataattacagaagcaaaatgtcatttggaaagggtgtgtttggtggtcagaattgtggttgccacgtgccttcgctaaatatcatgactaaaagggaaagacatgcagatctttgctaggaaggcaagagaaagaagaggtgaataaaaggcttgaagctcttgctactctaatcaaattgttttatttgtgagagttcgctttagcttgctctttatgtttgaacctaagtcttttcacctgtgacctcatcaccatttttctaatattgctcagctcattagccttgaaatttataatttagtttttacaccattttatcctatttcttcccattgccaagcacaaacatttactttgtaaaaaaacgtgactgaatttattaaaccagtttgtcttcaaaagtttcccttttttatagacatgggaagactcaaatagttggtttccctaattctcaggagacaaaccagtgaagctgaagccagttttgtatgcaactaaactttgtgccccgtcctttgggtctccaattagaataaaatcagggatgggcaggcagcgtgcattttaaatcaccatccatggtcactattatttccaaactcaaaggcaccattagaacagggaaacatttgcaggcatttcattacaccttgaactattaaaaaaaataagacattagaaagaagtgattactttaaaactttcacacactatggaacaaaagaaatggcaatacacagggagatattatagtaaacaaattgacgcacacggttgttgttagtgaaggacagtattacaagcagatgaggcaaatgaatgagttgggaagagagtcaatctcacttcctgaagcaggggcccttgagaagcctgtgccttttaggctgtttctttgtaggattggcctgggtgctgaaaatagcatagagccttttgcagaatcctttatttcaaggagttgcggtatttcatatgtggcacggcccctcccttcaatggcctctctcctgccactggaaggtgtttttacagttccccttgtgacaaaggacaggtcagagagcaaacctgtgagcaaatcaggcttggcacgcacatcactaagcaacagatgctttctggaaaaccatttgggagtgtttcagatagtagtatgtgtgtgtatatacaaacatatacataatttctggggaaaaaatacatacatacatgtgtacatccatactttctgaaaatcacacacacgcattttccagaaactcatttgaggttgattttatgtgtacggagacagagaaagccatccatccatatagaaagccttttgcaagtatttttaatttatttcatagaagcctgaatttatttcacacaacaatgaataaatccattcttttgccacagacgtggtgcaaaaagaggggtgtgcttgaagcatctacaaaggggaaaaagctgctgatacagggaaaaaatattaaagtaaaattttagttgtcagctttgtaattgaagctgtctcctcacttgaaaatattgtttccactgaagtagaagacaaagggggatctggcaaatgcccccacgatgttcatttccccagataaattacacacatcgtgtgtgcatgaagatgaccagaggctctcactgtgctggggatacagtccaatcattcattcaaggctctgtgtagtcatacaacaaacgcgtggcctaaatccattctttttcttctttttcctttctcttctcattttttcttttttcctccttcttctgccaaaagacagataaagtataataactttgatgacaacctcattttcaggatctctcgataaatcataatccttcagttgtattttccaaaacctgcagttagccaattacttcttggtttccttgaggtgaatctttgctttttaattatattttatcttcttcaaagaaaccactattgaaaaattatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgtgggccaggcaaggtggctcacatctgtaatcccagcacttagggaggctgaggtgggtggatcacctgaggtcaggagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcagaggttgcagtgagccaaggtcgtgtactccagcctgggtggcccagcgagagtacatctcaaaaaaaagaaaaagaaagaaaagaaaaggaaaaaagaatttctaagtctggttttcatagaaacaagtgcaaaacaagccagaggggtcattgccaaactagaaagaagcccagggccagaatatgcagggttagtggagaagcccagtgctcctgggcctgaccacctcttggactcggtataccatcataaacagcattcagtaaacatcttttttgaagaggcatagtaaagaactacctgctaagagtccagaaaccctgtgaggcctcagataactttagtaggaaataaccaagctcttgagttgcttgaagtagaatcccattagcttctaatgcttcctgtatttgcgccccattcaaggaagcaactctagagaatttctttgaatcctgttacttccatttgatgagtgagactcagctgtgatagtctatctgctttaagactgccgatacgatgtggcatgttctctaaagaaggcagaaggcttgaggacggtttgtgttgattgaagaacatttcagtgatgagttggaatatttagacaaatttcaaggcttaattaatatatgaaataaagtagttgcagagataacgaggaaaaccaaagttataatctatagttcatttaccttccttggtcagggcaaatattacaaaagatatgtactgcttttacaataatcagcaaatgggaatgactttgaatttcagaacacatatgggaatgtcatcaacttcgactttgaaatgtggctttttaaaattaaaatataaatcattctattgttaacaaaagtttatcaaaagtaatagggcttttgtagatttttggtttttcttttctattaagatctttactggtagagaaaaataaaattttattaattcaaagattccattgtgtttttatgtttgtgagtaataatcagtggttcctggtatctcatttcgtttttaattcccaaagcaggagctaataagcaaatcgctttgtgggtttctgtgaaaacagctagagtttgcacaatcgtcgcctagacagagggaggagtgtgggctctgaagttcagcagatttgcatttgactcttgactctgtgattagctgggtgtccttgagtaaactactcctgtaagcctcagttacctcatctgtaaaatagggatgatgacatctgctcaaagcgttgctgttgagtaattaggttaaatgagataaaaagtgcccattggcacctattggaactcagtaggagctcatgtcttcatggtgtgtaaatatgtacctggctcccatccacaagagtcctcgctgaatcaacaaactcacaagtgcctcttttcactagactgagactaaaaccgcgaattaaaatggtgtttgtcctcaagaaccactagggtcaagaattctacatggctcaggcagatcagctgagcacgtgagaaaataaggaatatgcagtctaagtacagagctcagatgaagcaacttgctgcctatcaacagaaagggtggaaacaccctggtgtgtgcaacaggcacaaatcatgtaattcagtaagtctacaaatatgtagttaaagaaacaatataatttctaaaagcagtctcctcgcagcaaactgtgaagttagcagcacagaagcaaactgaggcagagtcactggattggagacaagctgatttgtgaaagctgcttgagtaattgaccaacctctgcacaactatgttgcagtttactaaaccagtataaaggagaaaaaaagcagtagaaattaagagcattcgttaagctgtaagtcctttcattcttttggatatattattctaaatgcatcttataacattttcattaataaactgctgttttaattaatgatgaggtctcagtcaactgaatgacatttctttcaagaagcccacttcatacgcacacaaaagaaccctgaaatttttcactaaaggaaaggccaatgtgatccaactagttgaagaatatactattgcaattaaaaaatcatttaattccattcggctcaactcaatgaacatttattgaatatctgctggaggccaggggctagctgggattagacacagttcttcctttcagaaactcacagtctagagagaagcctggtgcatgaataaggcattcacctttaacctccttatccctgttctgttccttcccttctcttcctggtaaggcacgcttatttgcaaaagactttctacatgaaaaaaatatatatatgcatataggcatatacacacacatgtataaatattcatatataccctcaaagtagtttcccaaaattacttgtgtgtatacaaatattcatgttcatatatatatttttttatagaaatgggactatggtgttgtattaatgttggtttcctgactccaacttgctctcacatggttcaggaattacatataatatatattataatatatttaatatactagatatgtaacattaaaaattattttaattatatataatataatgttaaatataaatatatttaaatttttaatatttatatttaaattttgactaccatttgtattatatctaaatataacatatttaatatgagagagaaaacaaatatagtgaaatgttaaaagttagggaatccagatatggatgatataggagttattcatactatttttacaacttttcaaaattatttcaaggtatattggtcttgtaaaaaattttaaaataagggattcaagaccttcctggcctcaatcctgcctttcttcagcagcacctgcagccgtacatcaccccacatttaataccaagttatgtccaacatcctcccgctgtcgttcctgacgctgactgcacattagactaatctgagaaaatgctgaaatatgccaataggcaggcctctccccagacaatcagatcaggactcctgggagtttgctccagccatggttttttccaaaaacatagcctaggttgggaagcctggaggcctgtttcccaaacaccatgctgctgcattcctcatgccttggtgcctgctgtttccagtacttggagggtccttgtccacctcttcagtactgtagattcctattattttgtcaggatccaactcagatgtcgccttccttagtgaaaccatccaggcatcccacgccccacccacaggtagatcccatccttcccgcctcctgctatttatttctacacactctccttctacaggtttcccacactgttgtaatgctgtgtttgctctgtctcccaacccaccgcaaactccgtttgggaaaagtatatatcatgtttgcttttgtcatcagcatgagcctcacatatagtaggagtctaagaaatgtttactaaattaaatgcaaacaaggttatacttgttggaataaagttataacaaggagctatgggacacttgaggatgtgcactcttacagtgcaggcggcacttgcggaaggagatggagctcacgcagaatcgaagagtgaataaatagctaagtagtcgggcaggagagggaaatgggaacagcccgcctcttaggctggctggagccacgtggagtacgcgaaggagaatggccgctgaggccaagaagggagccagtccagacgatgaaggggaccaagagcgttagtcactctggaagcagagtgagcacctcgcactgcgctggcacacagatgcctctcagtcaagcattttagagaaataatgagtgaattcttttttgctctttttctttacatttggcaggggagtcatgggaccggattgaaactaactttcttcccagaagaatgtatttgcacatactttcccgaaaatgtcagaagatttacaggttttctgaaatgtattcagtgacacttcccccaaaatgatatgccacattctaagaagagggatatattttaggtttaagaaggacatggttagactaggatgtaaggcgggtcactgaaagtctgtgaaggacagattataggaggtaagatgcccattggaggacaccctttaagaagtcatcacagcgtggtggctcacgcttgtaatcccagcactttgggaggccgaggcgggcggatcacgaggtcaggagatcgagaccacggtgaaaccccgtctctactaaaaatacaaaaaaaaattagccgggtgtggtggcgggggcctgtagtcccagctactcagagaggctgaggcaggagaatggcgtgaacccgggaggcggagcttgcagtgagccaagattacgccactgcgctccagcctgggcgacagagcgagactccgtgtcaaaaaaaaaaaaaaaagaggtcatcacaggtgccaaagtgaaacccaagtgcctgaaccagaggcatgacagagctgtgcccaagagagaacagatgcaaaaggttacgaggcaatgcaaacagagagcttagggtgtctctaggctttctgcctttgagtgaccatgcagatgcagtgtcattggtcaaactagaaaattcggggagaggatcagatttgtgggaaaggatgaattccattgtgtgaagcttgagtttgggtttcccatgaaagaacaaggcggagtttccctacagaaagttgcaggttgggagtgatggagatgaggctctcctgatgagtgagtatagagtgtgatggaagaggagcactggagggaaaacctcagtgccccaacattttcaggatacacggaggaaaaagagccaatgccttacagagaagctgaaagaggggaaaggaaaaccaaagagagtttccaaaggctccaagagttgagtaaatcaaataagggcagaagtggtctgttcactttggtaactacgaagttcatgaacacctcagtgacagcaacttcacttcagtgaatggagttcaggccaaaatcaatgattaggaagtgaaaatgaggagatgagaaggtttctagaatttccccagttagattgggaaaatctaactggacctctgaacagcattctaacctattggtcagctcctctttcttgaaaaaccctttttccttggcctcattcagacctcgtgttcaaggggtccccggggtgccctaattacttcctctctgttcttcctttgcaagctcatttccctgtcccagtttgaaaagggtgacttctcagggccctcctgtcttctctcttcacacacttctcccagggaattctatccatgcttgcattgtaaataccatcataaaaatgattttaaaatgaatatttcagcccagacttttttggctctttgacttctatgcttccctgacacaaaggcacctcaaacttgacctgttcaaagctgaactttgttgttgttgaaacagcatctcactctgttgccccagctggagtgcaatggtgccatgatgggtccttgcagccccgacctcctgcactcaaatgatcctcccgcctcagtagctgggactacaggcttgtgccaccacaccggctatttttttcttttcttccttttttttttttttttttagcgacagggtccccctatgttgtccaggccagtcttaaactccagggctcaagcgaccctcctgccttggccttccaaagtgctgggattaccgtgtgagccacagcacccagccaaagctgaactcttgatacctgccatatccccaaccccaccaagattgcctgcctctgtgttcccataatcagaaattgtcaccaccatctatccaaaaatccgagtctgtcttaacactctttccttcacctttttaattcctaaacatcatcagattctgtccactctactactccaaaccatcattatatttattctgtcccattgcatagcctattcaatggtctacctatattccctcttttctctttccaatgcattcaccaaaatgcagccagaatgagctttcaaaactgaaatcagattatgtcacctttgcttaaaacctttcaggagttacccgttgctttctgtgtaaaaaccaaaatcctcagaataccacgacctttctatctagcctcacttcctactatggtctcccctgagggtttgtcatcttggcctccactacgttcatcctcgacattctcttcttcctcagagcctttgcacatgctcttttctcttcctagaatactttccctacccccgttaccagcaaaatctcactggccttcaattattaacttaaatgtaatttacgacctgctaaatctctgtcagctcatagttcacagatggcagttattacatatttgaaagaatggattaaaaagactgagtgctagccagaggaaaatagaggttcagggtaggggggcctttaagatgagaatgatttaaagcccacagcaatgaaatgatttgcctggccaaggtcaaaaagcgagttggtggcaaagccagggctgcaatccacgacttttgattcttggcctccccatgtcccacactaatcctttattatatgtcttagatgaagttagctgtagtgaagccctcatctcatttgctgtccccaaaacattctaacctgttgaccaccatgcacaacaggaatacgtattaacacagtttcaggagcatgacccaggaaattctataatagatgcaaactatcttcctgtttaagaccctagtagagttgttcagtggtgctgctcttaaattccaatccaagaaggccacccggctcccacacagtcaagccatagctgattgatgtgtttacagtaatatacttcacacttgtgtcttgtgggccacacgtgccactcaggataaacttagagatttttctttggcattttttctccattgtacagattcagacacttaaagcttattacatagaaactgacctagaagtgaccgggcctttggagagaatggcaggaaattggttacaatagatatggacccacctggggaaacagaactagcagaggtgaacgttaacccatcccaggtccaatgttgttagtccaaaaagattacagtaagttgaagaaaacatcaaacaaacagaataaaaaattcagcaaggaaattcagagtggtacacttggggagaaaaagcagattttgccaatgtaagaccaggagaaaaactggttgtgtttcagcattgcagtatcttgggagaataacaaaacaagtttaagcagagttgtgccatgcagattgcctggaaggaaccaggcctgcctgatgcagaatcatgatgcatgcagaggatgatgtccaaggtccccgggagcagaactccataaaattcacttaactcttttactaggtgactaattaaaaagcagttaatgagagtgatcattctgggcaatggaattcagccatgaaagtggttaatgacctgaggctgcagctcagttctatgcctcctctagcatggttctggctcccaggagagcctcctagactttagcagaagctgcacagagcttcaagaatccaggatatctgggaagaggtaggagagcgcattgggcgacagaaaggagtaagcaaatattaaagggtttatttacagcagaaggtaaaaagaaagaagctcaccacaatgggagctcaataaatgtggtttgcttgagcgactaccttgctgactgaaggagtggatagagcacgtgcatgaggcagcttgcacagtctgggagacctcgcttctcagctccttatttaatgacatcatgttggtagcttgaagtcggacaaggtggcagtattgacatcatgggaaataggcaaaaactataaatcagaatttttccctccccctcaagccagttgcttaacatctaccaacttaccattgggtcacttcgttgaaatccctgtgggagcagagttccctggggttcttaccttaagaataaacctgaaggcgttttggttttgctttcctattttaattactaatatacagtggcactcttcagtaatcttttattacacaaccagagtggctcagcatttgtgaagtctcctggcaaactcaccatcatttaaaacattgtttctgtggggaagttttccaagttgcaagttactgagtctaaaataaatttttggaaaagagcccatttgcaagttgggagctttcaattctgagtcctgataggaaagttagaaaacaaaaagaatcatgccaattttaaaaatataggttgcaaaatataggttgcaaaatcctaagtgaaaaggcaaaaggaatagaattatttaacttggagaagagaaagatgaagagcaattgaataataggagtgagtgccagctgttgtttgcttttggtttctgttttttgtgggtttttttttttctcccactgtaagcctcggggatttggttaaacaaggagataaatatctttatgttattattctggaatgaataattggtggattttatgtcaaacatctgcaaacttcttttcctcaatcagggataatttacatataacctgtgatgaggaccaagaaatagttaagacaaggttatttgtctacttgaaggttaactgtcaactttgtgaccctgagtccacagatggcataatgtatttcaaaactttgagaaacatgatataattaagcaaatcctttttatatcatagaatatctaaatacagaatttattatttttctatcaaaaatgattataaaacttagactattagcattatctatagtagtattatattgtctatatctgttagtattgtctattactagtatctatattactagtacaaaaccttaaaccaagcattctaaatcaatactttttgataattttacgagggaaatgatgctattttgggcttgttaatttagagttattttcagttattcattcagaagagatgagagaattgctttcttttagaatatcttttagatattgcagtaccctgatttggcattttcttaaagagatgtgaaacaatgaaatggcagctgtaaatctgccacttggagccttagagggcttacatcactcccaggctttgctttaacagttggtttatgatgtggtttcagaataacacttttgaacatggtatatcccttcctgcaaaactgacataaatccataaagcttttaatgatgtctctaaaatacagccaaagtagtctctgaggcatatttttggattgtttatctgaaatctctagattgctgaatctcccttcatgatctgccttggaatggctgtctccagggcagctgataaacgcatcatgtctcacccaggcggggaccactcagcttcgtgccccatcaggtacactaccctgcctcagctttcaccccaagcatctcacacccttgtgcgcataagtatcacctggggacctgcgaaaaatgctgcttctccagaacccctgagctaaattctgggactaggcctggggaccagcattttaacaggctcccaggaaagtggtcacagaaatgatgtgagagtctcagctctacatgctctctgactccagttctggcttcgggatggagtaactggagagaggctgacaggtggaagctgaggttcttgccggtgacacgctgcacctgtcactcaggtgctggggtctctgctgcccagacccttccctccctaggccaggttctgtgctcctcagtcttgaatttcaagcgcctggtatgcgtgtcttctcttgcacatcatcctgcctgccccactgtgattcatttgaatgccccagcctccatctctagcctgcctcccaccctccctccaagtcccaggtccacctcttctcacccccgccagagcctgttctcaggtaatgaccccccacattctctagcagaacctctctctgtggcaaactgaactgctcagtgtgttttctccaggcggcccgccctgcctgcccttcctgactcctcctccctcccctgtcctctgttagacacatttacagaagcctgtcctaggagtgtccatctgccccatcagactctgaactactgagggcaggggtcacctgtgccttgctcacgggatccccaacacccagctgaaatgtggtgggagcctcgggggtctcaagtgaatgactgattcttaaaaagaagcacgtgaagtttgtccaggcggcatgatgcctcagacttcagaccctctcactgccaatacactgtgccttcagctagaaagctagtcttcatctccgccacctacctgtacttggctacccacctctggccctccaggtcccagcttagatgtcttttcccacagcaagtcttccaccacccctgtgttccagggggccctgtgtctacctgatcctgcacttacccctctgcattctaataatctgtttacctgaatcctcctccaggtccggagctccttcagagcaagagttgtcagcacccagcatcgtgcccagggtgcagtcagtgctcaatagatgtttgctgaaagctaactcagcacatttaggtagtgagatggggttctcatcacatagctgctaaataaaccgccataacattcactgtattgtactcacactgttgatgcgtctcctcccacaaccactgctagatggaaatcttctcatgggaagtgattgtattttgttcatcttcacacttcagtaagtcaggcagcaatgagcatggattaagtagctgttcaatcctatgttttccaagaaggatagttttggcatgtggagcaggagaattctttttttatttttatgtatttatttatttttgagatggagtctctctctgcggccaggctggaatgcagtggcggatctcggctcagtacaacctccgcctcccaggttcaagtgattctcctgcctcagcctcccgagtagctaggactacaggcacctaccaccacgcctggctaatttttgtatttttagtagagacggggtttcaccgtgttggccagaatggtctcagtctcctggcctcgtgatccgccagcctcgacctaccaaagtgctgggattacaggcgagagccaccgcgccccgcccaggagaattcttaattgcataagacagccccacacattgcaggacatgctgctgtccttgcccgtgcccactaaatttcattggtatcccaatcattttgacaactaccccacctacacacacagttacaaaagttttgggggtaagaggaccaggaggaaaattgcactgcacatagttgaaaagctatagttaagtcttttccttacaacttggtgagaagcaatggactccgtaacagtgccatggtggattatatgtgtcaacataattaacagaaagaggatctctgaaatataagatatttatctggaaataaagcattgcaatgggaatatgcatgccatagttaactacatgcatattcagggaggtgaagacaaaagtttttaaaggaaaaaaggaggaggattacataattgttttaaaataattatccttggctacaaagatcaataacaagggtgacaccagtccaagtttggacaggcaaattcagggcagttgttcttgtagaaccgtttttttgtgtaaggttgcaatggtgtttgggcaatgttgtgctttttgcagagtctctgtgatagttcttttgatcaggcatttattcatggccttccccagctccatttctcagggctttcttttttttttttttttaacattagtgacttcattttgattctgacaactttcacacatgtgtgtggtgatgtgaggtgggggccaggacatgtcaccctcaatatacaacggtaacctgtctttgtaataatagttcactaatctttcctgagcacttatatattccgggcactaagctgtgtattatatagtttacttaatcctcacaaccacctatgaggtcccattttttagggacgaaattgaggctgagaaagtttcaagacattgacccaagttaacacggctgctacagacaagggcaagatacacccccaggcgtcggacttcgctgctctgtgccgacctctttaacaagaacaaacatcaaaattcccagttggaagactcctattaaaaactgtcctctcccattaattataacgtagagcagttttgcacaatatattctgcatagtgttaatttagtgggatgtcaagtgttgtgagattaacggttgcatgggcgatggagtgtgggaaatgctttcagcaaggcccttgtagaaggccgtgaaacagaaaccgtgaagaccacaggatccctaaggtggcacagcccttcacagtgagtcggagtgatttagaacattgctgagcaaacagcagggagaccggcaacaggagcttgctggccatgaagtgcctaatatccagtaagcactgctcaggctctaggaaaaggctgatgcaggaagggtttctttcttctaatttctcaataataataaaaatagatactatttatggagtactaattactctccacttcatagatgaaataccaaggcctagaaaaatgtgttaagtaacttctcctaaggtcacacagctatttagtggcagagccaaatttgaacccagttctctctaacttcaagacatgtgattgtaaaccctatacacaaagtctctaaggacgtagggcttataaaggctttcctgtatgaatatccaagcaaattcagtctcaaagaggatgcccctatgggttccctgtaccagggatttatttttggcatatctcttcaacctgacaattcgttccttggtctgagtacatgaaatttttttcagggtatgtgaatttttttcttggtatgtgaaatttttttctggtataatgtaagtttcttaaattttactatttttttaattttatagatttctatatgatatggtttggctctgtccccaccctaatttcaaattgtagttcccataatcccctcatgttgtggaagggacctggttggaagtaatttaatcacaggaggaggtctttcttgtgctgttcttatgataatgaataagtctcacaagagctgatggttttataaatgggagttcccctgcacatgtgctctctcttgcctgccgccatgtaagacatgactttgctcctcctttgccttccaccattattgtgaggcctccccagccatatggagctgtgagtccactaaacttctttctctttataaatcacccagtctctggtatgtctttattagcagcgtgggaacagactaatacatcataccctgttacatgctttttttttttttgataagagtatttgtgttgatgcaatagcatctttctccatagaacttactcagatgcccttcctggagccagtgcctgcactccatgaactgctggagaggtcattgtagggtatcggcatcagacctctcctcatttttcaattctctctctcctttataacagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggtaaggacaaggatacccagcctctgccatttaacatttgggcagacagaatgttctagcaagagtctatagattgttcttggtttgttatttattccccataggcttttttaagcaagtcacataacttctttgaaccccatttctctccatgaatatcaggaaaacaacttgccagctgggtgtgttagagcaaggtgttagagtaataatgttggtgaggcatgttgcgttctttacaagaatgctgttgcatgaataagagatatgtttgcatgtgtaatgattattttttctccctactaaataaacacatttggctggacactgtggctcacgcctgtaatcccagcactttgggaggccaaggtgggcggatcacttgagctcaagaatttgagaccagcctggccaatatggcgaaaccccatctctacaaaaaatacaaaaattagctgggtgtgatggcacatgcctgtagtcccagctactcaggaggccaagatgggaggatcacttgagcccaagatgtcaaggcttatagtgagccatgatcgtgccactgcactccaggctgggcaacagagtgagaccctgtctcaaaagaaaaaaaagactaataagaaagactaataaaacataaatacattcactaaatgtgctaaacagagatgggctttgaatgagtaaaattaattttacataaattaattttatcctgatttatgatagtataccagtaggttgttacagaacatctgaactttcaataggagtagaaaatcagaaatgtcttcattcccaatcctctcagaactttaaattcacaaagtgtatccctgtcataaaggttgcttaaagcaggagtttattttaattttttttgaaacagggtcttgctttgttgcccaggcttgagtacagtagcaggatcacagctcacttcagccctaacctctcaggctcaagcgatcctcccacctcagcctcccaagtagccgggatcacaggcacataccaccactcccagctaatttttttaattatttgtagagttgggggtctcacgatgttgccaggcctggtcttgaactcctggactcaagcgatcctcctgccttggccaaagtgctgggatgacaggcatgagccaccatgcccggcccaggggtgtatttttacttgtaatatcctgggccatcttggtcgtcaaacacacattaagccagagaggatctgagtgcacctaaaattggcatcctgaggagaatatgcaaatgggcttgtgacccttcagcagtgacctctgagagacatctaagaagccctggagtgtacaaacttgctgaacttgagaagtccacttcctctctgaaaatgaactcatataccttagaattctaagatcactcttttttttttttttttttttttttggagatggagtctcgctccatcaccaggctggagtgcagtggcgcaatctcggctcactgcaacctccgcccctcgagttcaagcaattctcctgccttaacctcctgagtagctgtgattacaggcctgcaccaccacgcctggctaatttttgtatttttagtagagacagggtttcacatgttggccaagacaatctcaatctcttgacctcgtgatccacctgccttggcctcccaaagtgctgggattactggtgtgaaccactgcgtcagccctaagatcacttttttaatgaataaaaatattttaagagcatgcaggaacaaatctctctaactcacttcccattggagccgaaaatatggagactctctctcccactgcccattgtttcctgcccttcagtgattattccactgttatggcatcttaaagagcaagaattttggctgggcactgtggctcatgcctgtaatcccagcactatggaaggctgaggcaggaggattgcttgagaccagtagttcaagattagcctaggcgacatagcaagacaccatttctaccaaaaataatttaaaaattaactgggcatgaaggtgcacacttgtggtctcagctgctcaaaaggctgaggcaggatgattgcttgaggccagtagttcaagactagcctgggcaacatagcaagactccatctctaccaaaaataattttaaaattaactgggcatggtgaggcacacctgtggtcctagctactagaaggctgaggggggaggatcgctggagcccagaagttgctggagcccagaagtgcaaggctgcagtgagctatgatcacgccactgtactccagcctgtataacagagcaagaccctgtctctaaaataaaataatttaaaaaaaaagaaaaaaggagatcaagatttttcccatgggagctagaactgttattactaacttaattcagcttgagttttaaaaaaacagtaaattaaactccctctctaggaaatgcactgttgcttaaaaagatggaggaaaaagtatgttccctagtattttccccttctgaaattattcctaaagaaataagccaaaagtcaaagattcatcatgaagatgttcatcataatgtttcgttttgttttttgagacggagtctcgctctgtcgcccaggccggagtgcagtggcatgatctcggctcactgcaagctctgccttccaggttcacaccattctcctgcctcagcctcccgagtagctgggactacaggcgcctgccacaacgcccggctaattttttgtaattttagtagagatggggtttcaccgtgttagccaggatgatctcaatctcctgacctcgtgatccgcccgcctcggccttccaaagtgctgggattacaggcgtgagccatcgtgcctggccaacatcataatgttaactatgaaaataaaaattgaaaagaatctgaaagttcaacttttagtaaaatagtaaaagagggagttgccattttatggaatattatgtatctattaaaatatttatgaatcgtgattaatgatatggggaaattttatgtatgttaaaccaaaaaaacatgaacaagatccagccttgaatgtgaaatattagctccataaaaaatatagggatagaaaaaaaaaagcaataatgtgaacacaaaagtgtttggttggattgtggatgatttttttttctcctgagcagtacttttgtatgcatgtcaaatgctttaatcagaaagatgaaaacagtaagtaaaatcagaaagtgaggatgaaagagagagaagtatggagcccctggtcttcaggagttcatcagtttatttctcctggatcagggtcaataggtttttttgacccactgatgttcactacccacatggaccagcctcccactgggcagataagaaccttgggtttcttctcaggtccctccccaggaggagggctctcacccagagactgtcaagaagttggtgaacacattcccacacatacttttattgtctgctcctcgagtcactgccacactagatttggtcctcaactgtattcgctacctcacatgcccactgctacacacccaccgctgctgtgccttcatcacctgccactgctgtgccctcatgcctgtgtgaggactttcattgtcttcaagggcgttgatcaatggattctgtattaatggccaccatttaatgaagctcactttgtgcccaaagccatcctgaatggtgccatgcattaattcccatgagctgcacaactctatgaagtagatactattattatttcctttctactgatggcaacacatgagtgcatggaggttgagtgccttgcacactcagaggatgttgggccaggctggggtttctcagcctgggtgtccgattccagacccaaagctccccaccggctgtactctccagggcaggcatctctggaactctcagtgttcttggaaggcaaagctgggtgggttctgtctcactgttacaagactatcctcaaactgctggtgaaaattcagctttttcagacttcaaatacaacatgtttttattatttgaagtttaaagttagaaaaaaaaggaaatcattaggaaaaaacatcagtaaggtctacgccaaagtatcaggaaaaagctactagaaagtctccactaaacaccctggcatcactcacatttcacatatcgaaagctctgctcactgtcctccagaaccagctgcccccagcaccaccactgcccatcagacacttgtgttcccaaggtcagtgtcactcaccagtgctccgttcttccctgcttttgtgggtcacccaggcaaacaagtcctgtgaattgaactcatggtgtccttttcctccccaccactactctctgaggcaaatatcttttaattcccagtagtgtttacgtcatggtgtccatagaaaattattatatttgaatggtaccagggtaaatggatgaggtcatgttttggaggccacctgcccagtgactccagctgccatccccttcttcatgtctgccacggtgtgaggggagccttgctcctggtaccccatcacccatctgtaggacagccgtgggcttcagcttgttggctgggaaattctctcccaatccatctctctgcttccagattctccccctcaccctttttcaccacagccagcaccgcctgcctttatagggtgtcttattttctgttgcttgtaacagaatacgtgaaactgggtaatttataaagaaaaggaatttatttcttatagttatggaggctaagaagtctgaggccaaagggccaaacctggtgagggccttattactggtgggaactctctgcagttctgagacagtgcagggcatgacatggcgaggttaagctgccagctcaggcctctcttcctcttcttatagacagtcccactcccatgagaacctgttaatccattaacccattaatccatgaatctatgaatggatcattccatgaatcgatgaatggatcattccatgaatcgatgaatggatcattccatgaatctatgaatggatcattccattcatgaggacagagtcctcatgatccaatcacctcttaaagggctcacctctcaatatacccatattagggattaagtttcaacctgagttttggaggggatattcacaccatagcatagggatattgcttaaaagggatcttgtataatgtctttattaaacactcagtggtgccccactccagcaaaaccaggagagactcctcagtgccacaaacttttaagtttgagacccaccaagctcatgggtgagatggtggcctgtagagctggaccgtctgggtttgaggtcggctttgccttttgtcagttgtcttgggcaatcagttggcagctccatgcctctgtttgctcatccataaaatagtgtctccctcacaggagtgttgtgaaactcaaatgacaatatgcatgtgtcaacagttattatttcccaggtccacggattcaatctacattctaacgcatattcagcaacccctactcttcgttttgagaaactcattacccctcaagcactctgtggtcatatgtgcacctgactttatgcctgcaatactcccttacctagaaatgccccaacttcctctctagccagacacctgcctttcattctaggctgagatcaagtcccacctccttttgatgacttctccttgctttaaactcctattccacttactttcaatgtcatttgtttggcatttaatgtactgtattgttatctgtctctgtgataaatatgccctgtcttcccagagagatgaaaagctcccagcactacatctcctgcctacgatcagtaccctgtaagtgtgtgctgatgataatgatgatgaccaggagagaataaatctgttaagcatgttatttgctgcatccaataaaagagaagtcccttataactgctttaattcacttgggagatgaacatgagacacagaagtgaagcacctcagcatttgaataatgttttattttaatggacaaatactagcattcttcctaccatcatttagcggtcctcttctgctgttatctgaaaggaataaatacatcatttaaattggattattcaagaatatcaccattactgtttatagatagtcactatatataaatttaaagttccaactcatctttctttctcaaagccaataatttctgctgccattaagtgaagcagttataggaatttaaaatcatatttacaaagtccaagaaggacagaaaagaaaaaaaagagaaaacaatgctgattttaatagagctgaggaacataaaggggccagtgacaaagtgacagcagagaggaaaatgtccagcgttttgcataattgccggttcctccgacctctaggcctctgtgtgtttgtatcctcagagccacacacatattgcctgacccatgccaggggatgggcatggctgtatgtgttataagtggactctacacttgtaaccaggcagaaagcctattttcagacctttaaaaaaaaaaagctgtgctttgcacaggaactaaatatatgtgttctgaagaaatgaataagagatgaatcaaggcagctgtatatttaagaaaactggctgggatgatatgatgtcagagcaccagaaataaggcagagagtaaaaacctaagacaatcaacgtgttttttctgcgtgttgccaaacaactgcctgatcatctccgtcattcccaaacaatggactattttaatgctattgggtaaaggaaaaaccgagtaaacactgaggggtggagagagaagcagctcaagaagtaggagcagcatattcaaaggccctgaggtaggaggagatcgtattttctagggaataagagaagttcgtggtagtttgaatgtaaaaagtgacagtgagtggtatgacttgaaaataaagtagcaggaggaatgcacatcagacagggcattgcaaccgctatttggaaagtacatctttattctgtaaagaattggaaggctttgaaggattttaaatgacccaataaaataatcagttacacattttgaaaacatggggaagaagacggtacagaagcagggagactgtattcatctgttctcacgctgctatgaagaaatacctgagactgggcaatttataaacgaaagattttcattgactcgcagttccgcatggctggggaggcctcaggaaacttacagtaatggtggaaggggaagcaagcacgtccttcttcacatggcggcaggagggagaagtgcagagcaaaggagggaaaggccccttataaaaccatccgatctcatcacaactcagtcactatcatgagaacagcacagaggtaaccaccctcatgattcagttacctcccactgggtccctcccatggcacatggggattatgggaactacaatttaagatgacatttggatagggacacagccaaaccatatcagagaccattcagtcatttattcaacaaatatttattccactcctactgtgcatcaggcactattctagacattgggaatagtcataaagaatagaaacaaaaattcttgctctcatggagcttatctttgaataggagaagacagacaataaacaaattggtacaatctatagtatgttgtgtgctaagaactgttatggggaaaatatgaggcagaaaagggagggcctggccaaggggaaggagagggtaaattccacttttaatgaggaagtcacagaaatgatcactgagaagaggacatgagagcaaagacctgaaggagtgagggcatagccatgcagagacctggggaatgagcatcctgaacagaagaaccggtgactgcaaaggcccttgggtaggaacaggaagccaatgtggatggtgaggagtgagcaaggaggagagtaacaggaggttaggtcagcaataatgaggagatcatatggggcctggtgagccattgcaagaagtttgatttttactctgagacggggagttactgggattttgagcagaggatcactctgaccaccgtgtggtgaggacactgtgtatctcagggtcagaggcccagtgggatcagggaaggttggagaaaggacaaaagctagtataatcccagcaaaagacactggtggcttggtccagggggtagagatggagatggcgacaagtggtaagattcagggcatattttgaagatcaagccaagaagacttggtgtcagatgacacatgtcatataggagaaagaggacagtcaaggcttttggcaagaataactggaaggatgaattggcaattcactgaaatgtggaaaactgcaatggaatacttttggggagagaagatggatgttctgttgcatatgttatgtttggggttgccagtaagatatctgagggaaaatatcaagtagacagtttgtgaaagagtctcctcaatgccactgtgtctcctcaaatgaatgtgctgaaaagttatttaactcactcttagtaagaaactactcctagaatttattcattaattttcaaatgataatttcacacttcttgactggaatatcattttgaagattgctgataagtacaggtgtttctgtagcttattaataaaaatatgctattattaaaaaaaaagagtctggagttcaagagagaagtctgactagggtatgaatgtggtgtctgatgggcatacaccttattcaaaggtcctacataggataggattgttggagtaggtaggtagacacacgagcagggcagaagagggtgccccctcccaccaaccaccaagaatgtcagacaaccatcaggtgatggtcaggcagttgctaaactgtctctctctaaaatgataattggctgcagctggcaccaaggaacgaccgtctcccaatagatagaaaacatctggagctggtgatcagcagcttcccaatcagatctcaggagttgggcaagcgggcccaagcatgcacactaagaggcaaaatgatggagtttaacgggtatatgaccttcctctaggaacactcaactggaaaggggaaaaaaaatgcctcaaatgagcatgcgcactacttcagtaaacacctgtgcatgcagcccctcccacgtgctcgcaggccactgcgcatgcagacagcccgccccaagggaagaatcaggggagaagaaaccaaaccccagaactatgccaatgtataaaaccccaaatcaagggccaaacagggcacttggatctctcaagtcgcccgcttggccctcttccaagtgcacttcctttctaaaactttttaataaactttcactcctgctctactaaaacttgccgcagtctctccctctgccttaaacctacttctgcccctcaagccgcattctttcctctgaggaggcaaggatcaagtttgctgcagaccctttgggattttccttcagtaacaggatcaccatggaaacaggcctgaatacaaaagagaatatgcttcagggctggtctttggggactgcaagagtaaggtgccccaaaacgaggggaaaaacaggtagagaaggaaaaccgaaagagtgtgtgctggaagccaagtgttcccgggaggtgaatgaattctgtgccgagtgaagatgaggcctgagagggacaattgcctctacttccccaagggtcacgggcccagcaagagaccgtggagcagggaagacagaagtgagacagagggctcatgctaaaatagggacgggtttggaggcagcaagtgtacccatctcttttcatggggttcggagcaaagaaaagcaaaggataagaggcctcacttgagagtgaaatgaggtcaagagcagtaatttttaaagaggaggctgactaagacccaccatcttctgcaatccaggcagaagatggtgcaggtaaagcacaggtgaggatgaaccaggagctctgtgtggagctgcctcagccagggagcaggctccctctggaattcacacaaggacactgtgggtgccaacagaaagcctgtggttaccgaagtggaaaagagtgagggaatttagatagatttaggagacgaaaatccaatccacggtgcttagttgaaatgccaggggcaaaggagtctaggatgacattctaaggtaaaactcagaaatagtgaaggtttgttgaatttcgtttagaaaacaaatataggaaatgtaattagctcttgattattctaacaaatgttcctttgaaatccaggaacatggcaagtgtaatgttaggatgcctaaataaggaagagcacagcgtgtgtgtgtgtgtgtgtgtgtgtgtgtgtgtgtgtgtgtgtgtgtgtgtgaaagtctggaaggagctactcccaagatgtttagaaaaattatctttgggtggtgggatttcaggtgactttcttttattttttttctgtttactttctatgttttaattagcatgttttattttgtaacttaaaatcagaatatcagttttgttcccctaaaaaggaaatgaaaggtgacaaataatccattaggtgatttgcagttggtcaaattcttgctagattgctggctccatttttaagctctgagatatcaacatgaaaattccaatttgagtaacaaatgagataaaatattgatgtctttaaaactcataactaagatataatatttatgcttgcagattaactaaaagcaggatctacattgtcatattagttattttcaatattgttttttattgttgggacgaagcaaggaggaaaaaaagaatatactgttgaggcaaagtgaactatcattgagggcaaaaagggactcaggggaccagggaaagccatctttcctgttgatttgcatttgattagtctgtaagctaaaataaaatttattacttggtctcaatgaggccacccaaaatctcatctttaagaactatgtttggccaggagcgtcggctcacgcctgtaatcccagcactttgggaggctgaggctggcagatgacgaggtccggagatcgagatcatcctggctaatacggtgaaaccccgtctctactaaaaataccaaaaaaaaaattagcccagcgtggtagcgtgcgcctgtagtcccagctactggggatgctgagacaggagaatggcgtgaacccgggaggcggagcttacagtgagccgagatcgcgccactgcactccagcctgggcgacagagcgagactctgtttcaaaaaaaaaaaaaaaactatgtttatttttaatattgtatgctcatgattcttttatatgcccaatgtcacactttgctgacggggtgagaacatccctgcactctgcatttatttttttatttcacatagtgtttcgtgggacctgcagatgtctcctccctgcagtcctatattgtatatgctctcattctttgtgtccaggcataatcccaacttggatcatttaaactatttgcatcttcaactttgagacgacagtcactgaagttcactgtgggcagattgtaaatatgtgcgagcctggtgctgtcagccgatatgggtcagtaggcctctgagctcgtgaatccaaattcaaatattgaatgttatctgtggacatcaagggagggagtaaagtttaacagaaattggatgggcatggtggctcacgcctgtaatcccagcactttgggaggctgaggcgaacggatagcctgaggtcagaatttcgagaccagcctggccagcatggtgaaacccccatcactactgaaaatacaaaaattagccaggcgtggtggcaggtgcctgtaatgccagctactcaggaagctgaggcaggagaatcgcttgaacctgggaggcagaggttgcagtgagccaagatcgcaccattgcactccagcctgggcaagagcaagactccgtcaaaaaaaagaaagaaaagaaaagaaaggaagaaagaaagaatctaagagcaggaattgaggggatgtgacattaaaatgaaatttagggcaaacaaattactgagctttcttttttcttctataggaagcttacagattcgatacaacctgggtggcacccgagagccatacaatattgacgtagaccacaggaacatggccaatggacagccccacagtgtcaacatcacccgccacgagaagaccatctttctcaaggtatacatacatgtacatataaattacatataatatcgcattatagtccctgtccctataatgcttggccattggttttgttttgaggggatagaagtagaagagatgctttttacactttctcctacaagtgcataactagtgaagtagaaatatatataattctgacaaggaaagacaatgatgaagttgaagacatcttttagggggaaatagaataaatgtttattccgtatagtctttctggttttcccagttctagatccacatatctatcaatttactgcttttatccattgcaccatctttcttcgccaagctctcagacatctgaaacttaccgtgtttcccagcaaaggttattttggtttctccgacctacttctttcactgctccaacacaatacaaagagctgtatttttctctctctctctgcagagcctttgtcttaaaaatcctcaaaacagtctttccccagaatctcagactctgactgtgggctttcggcacacaaagggatggttttattatgacactcaaattttacttcaggttcattgacgaccccggccctcaccactgatttttacagtgaagaaaccagcttgggaaacaccatgaataaaacataatgtgaggaggtctccctgggagctaggccaagacatcaaggatgggaactgtcactgcattctctagaaggagttcaaaatagatgcctgtcaggagaaagaacagcaggaggatgctgttttgtcagtaaagtggagtgtcatttggcaggggttcagcagcctctcagacctcattctgattcggctggatgctgtgggaagttcaggttgcaaagaaaaggcacaagccctatctcttttgagcactggtggatgtcagattcataacttgatatggagtttgcgcgtggcctttagcagtaaatgctagagggcattttaaggagaggcctttcctaggaaactgacatgcactgtttcagcttactgcgccatcaatcaaaggtggcataataaggttctctcatcatggtcgacagagtcccagagcccagcacagtacctggcacacattaggggtgacaaattctttatggagtaaaccaagcccatctttaaccaagttttagtcagaaaagccagcaagtccaggagacagatcgttttacatcatttcatcaacattgtctccctcggcttttgattagagactttttccattttaagccacccaatttgtcacctcttttaaagaaagtgacttatcttgccattttaccattgcgaaataatactaaaacttaaaaagacctaaacaatggcttttcagacagtataacagcagagacccaccacagccatagaatcgtatacagtttaccctcactctctgccacagtgaattagagaaagacttgaggaaggggagaggagtggatgatttttaagacttggggctttggaggcacagaaagccagagatatagacagtggagcagccagagacctgcagagaatccaggggatgaatgggtttgggggagggtctggttctattgcccaagactattttggttgcaaatgatagaaaagcaattcagaagtaatttgttggggaaaattcctagggtaggtcatagaattatagaatttgaaaaagataaaaccaaactttgggaagagaatctagggagcctggagaattaaaactgtggactagaataccactaggtttctctctcccttccttccttccctccctctttttcattctcatctctgcctctctctgaagactggattaattacctcttactgcatgctccatctttcacatatcctaggccatagtcacaggagtactgggctcatgtcttcccaattttgttaccggaagaaggggtcctagtttcttgacactcattttaaaatcccagggaatctctgataggcctggtttgagtcacgtgctcaccttgttgggtggaagggggaacaaagacccatagtccctaatcacatctcttgattagagtggggaacttgggaaactccctcaaaagaacagaatgcagttccagaaaaaggaaggagataggacgacaggagtgaaaattttggatgcacgattctgaggtaggagaggagaaaaacctgggaagtgcttcctcgattccgccctaggttctgcacctggaagtgttgggagatccagctctccctccttctctgtcatgtaatgtaactgactgcagtaagatttctgaatgtcccaacccacgtgagggcaactaggaaagatgtcacggcctggggagctccaatctctcagcccagcctgtcccatctaccctgggacctgcccaccactgagggcaaaaagaaagtaaagatagaggtggtggaggaagacaagatgtagttcctccttatggaaaagcagatcccagggcttctcactcccatgccccactttctttcatgcagggaggccttgcagacgtggaagtaattcggaaagtgctttgcaacaccaaataacactgcaattttttcttaaaacaatctaaaaatccatcttgagaacttctacagcctcaactgtgtgtggaaagagatataataaaatgttcacagtgatcatctgtgtgtgaagggattatcaatggtttgatttcctctagagttttctatttccccattttctattataagcacatgctgcatttttataatcaaacagaaatatgaaacagccatatattctcaacctattctggtagtccccagttataataacatatgataacaaaggcatttcaataatttcaaattaatatttatttatttatagtcaaagaacaaaaataaggctaatgcaaagatgaatggtagatcacagtgctgtggaatgatgtctttggaattaaggtgaatgttgatgcatttatacatgctcaaacatataatttagatgatcctcatcagtgtttatggtgtctttaaaagcaggtttactttcgtagctgggtttggctaaagctaacattaaattaatctgcattccctcagcacacaccctgtgaaacagcactgagcacttgagggaaactgaccttggatgaaacatttgctgccaaaagacaaagtacccagtctccacatagataacagggaactgactgtagtagttatcagacaccagcgtgaaccagaacccatggcatacctccagtggcatcatttgtgaaaactcacagtcgcatcagggagaatagcttaaggcttaatgccagtcaaaatataaacaaacaaggtgcagccagagagcacctgaaaaagtctggcatgcagtgaaaaattatgtcaattagcatgaatccaaaagcgaaacattctaatcaacaattccaaagccttgtgcaactaaccctttcttcttcctttccttccttccgtcttgccatccatgtttcttttccttcctattttttcctttctctcttcccaaccacattgcacaagggatctaagggggtttacagggagaatattaaatgaaatagagagttaatggaagtcacaaaaagtaagtccccaagatcgagaaaatagaacatgattatcaggtcacaaggtcttaccacttggataaatttgactgtgaacttctcggcagccagaagtatgcaacccataaggatgaactaagccagttcctcttgagaattgaaccttttgttattatatcatttttattttatttaattccatggattgtatttactgacatagaaaatgcccatagcatactccacttatacaacatcacatacacgataacagctcacatgtattggtgcttactgtgtccaaggcaacgtgctaagcactttagacacattttctcatttagtcatcacaaaaactttatgaagtatgtgccatcattattcccatctgatgtgttttggaatgtgtccctgtccaaatctcatgtcaaattataatccccaatgttgaaggaggagcttggtgggaggtgattggaccatgggggtggatttccccctagatgttcttgtgatagtgagtgagttctcatgaggtctggttgtttaaaagtgtgtagcacctcctgctttgccctcttcctccttctcaggccatgtaagacatgcctgctacccctttgtcttctactatgattgtaagtttcctgaggtctccccagccatgcttcctgtacagcctgtagaactgtgagtcaattaaacctcttttctttataaattacccagtctcaggtagttctttatagcagtgcaagaatggactaatataccatcttagagatgtggaaattaaagttcataaagtaagatgcaacctgcccaaagttagaaagcggtaaatggccacagcatagtcgaacccaggtccgtcatacttcaaagtgtacacaggctcttaaccttgcttaatagacagatgtctggaaggatgttcacaaaattttagaagcagatacctctggctggtaagaaattaagtgatgttactgttattaccataagatagttcaaaatatgcaaaaacacagagaataataaaccatatgctatgtacccaccattgaaacattacaaatttcgacattttgccctatttcttcagatttttttaaacacagcaacaattaagagtctgttgtcctcctggttacatagtgggccccaataaaagtcagagtcaatgccctcagcagcatttctgcaaatgtatttgttacaaggctgttagatgctgaagctccttgggaaagtaaagcttcccattttgaattcagcccaaacaagtctgtagagagtgaggtagagcaggatgatggacagatgaagaggccaaaggctgagatgatgcagctttctgaaattttgaactgatcctaggataaaactagctggaaaatgataatgaataaactacatgttctttgaataattatccatgacaatcacacatttttgggtttagatgtgagttagacaatagagagttcagggatatattctctggcacagatactcggaatccatattctctacaaatcaaatgaacagatggtaaggatgtatcattttggctttcatctaactagagggccatcttatctttgccaagaagaagctaacagattttctgcaagcaaaataaggcctttcttagaaaataattctaggtcctcaggaacaaatgatgattagatccccaagttcttacaccaaaaagaggatgactttgattattttcactgggaattttcaaaacaaatgttcaaaaatatcactgaattctgttctttaaaataatataagcacggtaatttcttacctgctactaatctgaatttcaaccaaattgtataaaaacaattgcatcaattgttaattgaactaggtcctgtatataaatcttaagaactgtcagagaagtgtcaaaaacattagcaacatgtagtgtgctaggtgctagaagtagaagaaaggatacaaatattaggatgatgccagttgctatacaaattagccctcaaatgtccatgttttaacccaataaaagtctgtcttacatcagatatattttcagaaaaggaaagttctctggtctccagcagtgatgaaattgtgctgggcaggcactctgaggacctgccactgccaccaacttccctgcttccccaaccctggattaggccaaattattgtccattattcttgaagccctcctgggctccatcctctgggaggctcttccttgtgtgtgttcagccatggcctcccctgaattatgtgccggataatgtgctccttacagctgtgcagcaattatttttttttttttttttttgagacggagtcttgctctgtcaccaggctggagtgcagcggcacgatcttggctcattgcaacttccacctcccgggttcaagtgaatctcctgtgtcagtctcccaagtagctgggagtacaggcgtgtgccaccacgcccagctaattttttgtaattttagtagagacagggtttcactgtgttagccaggatggtctcgatctcctgacctcgtgatccaccctccttggcctcccaaagtgctggaattacaggtgtgagccaccgcgcctggctacagctgtgcagctttaaggcccatttcctgcaggttcaaattacactaagggttttttacactcataagccttttgtggactagatctgtgctttcttttccaatacaattccctcaaaacccaaggtggcttctgatcaatttgcttctggtaagtttcatgtgctggtaaatgcaccctaagctcttccctagacatcaatcttagacttactcaatcatttgcctccaggcgcccatgcctctctctctcaaggtaatggcagctactttggggccagtggacacaaaaggcttgggtgggaagtaaagacccttaatttaaatgttacccgtgaggctaagtcagtttgctaaacagaaatcttactgccccattgttggtcaaagcggtttgcagtgttatttcttactctctagtgtaaggctctaaatatctagacttttttctattcttttcattgattattgggaactggtcaattctttcctgaactcatctgctccatgacatgaggagcaaaaagcaactgacacacacgaccattctgtctcttttgaagaactttccttaaagctacttaggcatttagtctgccttccaggttatgtgaggtgacagttttacaaaatattttattgcatactatattagtctgtcttgcactgctataaagaaatacctgagactgagtaattcataaagaaaaaaaaggtttagttggctcacagttctgcaggctgtacaagacgcatagcagcttctgcttctggggagacctcaggaagcttagatggcagacagcaaagggaaagtaggcttgtcttacatggcaggagcaggactgagagagagtgaaggtgctacgcactttcaaacaaccagatctcatgagaactcacatattatcaggagaacagcaccaagagggtggtgctaaaccgttcatagagctctgcttccatgatcccatcaactcccaccatgacctcattttggacactgggaattacaactcaacatgagatttgagcagggacacatatccaaaccatatcacataccattcttcctctgtctttcaagtccctaatattcattcctgcaccacctgccaccttaccacaaagccaatgctacatgtgttaggtttctgttatagcagcaccctgccttaagataccaatgtatgtattcgttagggttgtattcgctgctataacaaaaaatcagaggcttaatacaaataactttctttcccacataatagtaaaatgatttctagttggaaatcgtaagcaatatataaataggctgataaaaaaggtgtttgtactaatgtccaaaaataatagagtaaaagacattgtggttctatgctataactataaggctttgaaggaaggataagatgttaacctgtgaatggggggcaagagaggacatggaagaatatttattatggaagagggagaaggagagggaagatgtgtgttccaaaagagaacatgatgttaaacaaagatgctagcagagtgactatttcatagatttcatcctgtctctatctcatgaatagaaaagaccactggagaagactcagtaaaaagtcttacctggagaaattctcactctgaaatatgtaacatcaaatggtctgaagtcatttatgaatattgaatgctgtaaagtcagtagtctgaggcacatgcagagtggtgtcaaaaattgttggaagaattttatcagcagcaaaatgagagtaattcaattatggactcctagggcagcaccaaatgttaattgacgtgaaacattggtggccgggggagccctagttcaccactttctatatgtggaaaagtgtacaattgtaaggactttcacataacctcctcaagcccagagaaaaatctctgtagacttgagagggccttaatgatcatgttaggtagtgctcaaagccctttcttacatatcgaaatgcttgcccacattgccattctcagccttatgaactggaaatagctggtgctattagtcccattatatacatgagaaaacagagattaagaagtcccaggccaggcgcggtggctcacgcctgtaatcccagcacttcgggaggccgaggcgggtggatcatgatgtcaagagatcgagaccatcctgaccaacatggtgaaaccccatctctactaaaaatacaaaaattagctggacatgggggtgcacgcctgtagtcccagctactcagggggctgagacaggagaatcgcttgaacccgggaggcagaggttgcagtgagctgagatcgtgccactgcactccagcctggtgacagagcgaaactccatctcaaaaaaaaagaagtcccaatgatgaataaggtcccagtgctcacaagagacatgatcttctctagaacccagctaaccagaccccgtttccccacttagtttgctctttgttgtctttgcaagtgggcaagagaagcaagctcactcctgttcatttgccttataaacttttgaaattttttaaaaatgtttacgcaaaattaagtcttttgaggatttgtgttttctttggagtcactaaaagcaatgactttatagcgtttcgtagggggtcataaaaccctaatttttataatcaaagagaactacaaggtccaacgttaaggctagtgtttttacagcacacagtatcatacacccataaaaattccatctcattctttaagtaaatatgaacataacctcttgtctgtccattttaggatccttcttttctgtagaaacatggagcccagactgaaattagatactgaagctcaaataaattatttaaaaatgtgtgcctttattacccttgaactttctgccaataaagaacaatactaacaagcatatggatgtaaacactcctaaaaattttactatcagaagttgttcatgcctttattaaggaaaataacacagtttggaagcactaaattttttagggatgtcagaacaaataaagaaagttgacctagctagcctagggcactgctcttgaaattacatttactgtaactccttccctttggctaatttagtttttatctactctggatgataaactcacagcctgggttgtgcaatacaagcatgcttgacagaaggcaggcaattgcaagaataatgatgagccatttgaacactctggcttcttcccttccagaagaacttttacctattatagcactggctctctattgggattcttagcaagtgtattagcacttaactttccactttaatgaacgactgacatgtataattctatggagagcataggccaatattttattagtttctgatagtattacaatggtttgagtctattgaactgatatagaagatctatgggaagagaagagagagggctacatatattgggaagttgcccattaatttggtctgtatatgagtcagaattcattttttcttctatatttctatgtatccagagaagcctgttcatgattgagagacacatcaaaaacctcatgacctcattagcttttgtaatgtcgcctctggttttgggttgagctatggctcctcggcccctgagaaagtatttgagcacgttttcattatttggttcagaaagtagcagtatttgacaaaatgtttctgaaaagaggaaacaagatgcccaactaccagagcctcagattcctctccctcccagtaccttcaaaccagcttgaagttttaaactcaggccacctccacactgagaggtctggccagcccgtatgcaaggacatggttcctaggagtgtggtggaggcgtgtggtgaagatcctgctgaagaagacagaaggttctcaagatgtccaggactcttctgttatcaatgtacttctcttctacttaaagccacatggggtccctaagaatttaacatgatgatatctaattgacattctctcttacccctgcctaccactaaacccaccacatggtgagaaagttccaaacagcaatcgtttctgaagcctgatttggataaaaccagatggtcaccaaaaccattccattaggccatttactgatgtggaatgcaattaaaattgattccactttaatcaaaataactttgaggagaacaaatatgtgctgagtatctacaatataaaagaaatttggatagataatgatgagttggtggaacagtaggtgactcatacagggatgaataaaatgtatcttttacaactcaaggagtttatattctgggaggggagaaaagatgtgtccagtcactaggcattttgtcagataatagaaacctgttccacctacttctcctctagaagacagtttgacaagtctccttatcaacatgtaaataataaaaagggtatccagcaaaagagaatattagcagtttggggtggtgataaggacacagcacgtaacgagatttccccttgaggacaatgtcagtgtaaacagagaccccacggattacaaactgttgaattcagaggttattattaagacataaatttaaaagggtctttattgataggctaccttactatattagggctctctagcaggacagaactaataggatagatgcatatataaaggggagtgtattaaggaatattgactcacacgatcacaagctgagatcccacagtagaccgtctacaagctgaggaccaaggaagccagtcagattcctaaaacctcaaaagtagggaagccaacagtacagccttcagtctgtggtcgaaggtccaagagtaccaaagctgacgaatttggagtccaatgtttgagggcaggaagcatcccagcatgggagaaagatgaaggccagaagatgcagccagtccagtccttccacgttcccctacctgcttttatcctagctgcactggcagctgattagatggtgcccacccagattgagggtgggtctgcctttcccagtctactgactcaaatggtaatctcctctggcaacaccctcacagacacacccaggaacaatactttgcatccttcaattcaaccaagttgacagtcagtattaaccatcacacttacttaatagctctgtgttctctagcaagttaatgaaatctctgttgacttaatttctaaaattggagtaagtccatcttttctaatgcagtttgtgtatgttaaatggaaatacaaaaaaaaatctagcatagtctatgacccaataaaacggtagttttcttccttcattcccaattcccttctctttcttaaaagcaaaaaataaaatagcagatgtcaggatcagtaccaacaggctctttgggactatggtttctttccattgatttgtagttcaacccattaagcatattctcagcacctagtatattcccagcatgcagcatggctgttgcctccatgagcccagtccagtagaagaaagaccatcagtcatacagatatgaaccaagtgcccattgaagtataagcttgtgctgtgggagcacagaaaagtaggggaatgaataatcctgaggaggaaagagtggatcagagcagtctcacaaaggcatttgagctgttccttcaaggtttccatggtggaggggggaggatcacattagcttatttattttttactacagagattcaacatttgcccttcataaaaattatacagaaaatatgttaagaaaataagttctaagccatcaagcccatctgatctgaaacagaaaaagactcataatgaatatgtcaacacttccacatttttcatttgttttctaaagcaatttcatctgcaaatgaattatgcactccagggctagacagtacctccattcctacactccagaaaaatgtgtttacttcgttttacatttcatgcagctcagtgggaaggcagttgcaatgcaatttctgatccagtttagggtttgagatgtcagtcctctctttctttctccagaatacggctaaagcttgtaagaccaaggttgggagttcacttttttttcctccaagtgcattaaatacataaatcacctctcaagaaagaacataaggttcctggatttctattttgtctggcatgaaaactaaagtccaatctgcaaagcatcatactgttatatccatctgcagtgcactaaaatcactctcaaagattgtaactcttggagcaaatttttagcacaatgggcagagcgggttgtttcttgcccaggtaactgaagcaggttcttatctcacctaaattcatcttctgtctgaaaagtaagtgtatctcaacatgcggtttgaggttctgaagggttccacgctgcccttccactcaggcagggagaagtcagtcctgggattgagtctgaagattttgatggacatggtcctggagcgagttcggagctagtgttaaaatgccctctagtggtcattagctgtaaccagtgagcgtagggaagggaaaatcttgtgaaactggcttgggtgtggttttctataaacaccgaccaaaaccagagtcctaggttatagcgcgggttacttgcatctgtcgcggataccgcgatggcggtaggacttggtattacttatagaaatggaagcttgccgttgcattcaaagggtacaatccagggatttttcttacgctttcacatctcactgctctgtccctgagccctgggcacacacgagagtttcaagaagtgttgactgagtgactgaatacgtgaaggaatccagtttatgaatcatggattctgtgcacattcaatgagcttggctatttgaaagtgcacaaattcttcctgctttctgaagtattaaatatatttgatttgcatcctttccccagtggtcgcttggtgagctaataattgcctttcctcttatatctttgagctgaggaaatataatcaaaatgttaaggagaggggcaacaaaccccccctttgtgggtagaagagaaggtctgggctggcagctcaagagaaaagatgaagaaaggacatccaaaaagaagtggaagtcagagaatgaataaaacacatgagcgaatggctgccatcctatccgagcatccttcctgatattgtcacccagggccaccagcagaggttacatggtgagaacagacagtagaaatcagcccactccaccgatctgactcctggtctcctggggaaatggcattaggatctaggttaccaacatcatagcttctgccagggcttgtgtgcttaaccccaacagtggaacaccacaaatgcacaggggcagtagcctccaacatcctgaccatctctgagaacctgtcctgctagcagaggggacagaggctgtacaaatcagaaagttgacgtattagtccattttcacgctgctgataaagacgtacctgagactgcgtaatttacaaaagaaaagggtttaatggaaaagtcacggttccacatggctggggaagtctcacaatcatggtggaaggcaaggaggagcaagtcacatcttacgtggatggaggcaggcaagagagagagcgcttgtggaggggaatgcctctttttaaacccgtcagatctcgtgagacttattcactatcacaagaacagcatgagaaagactggcccccatgattcgattacttcccaccaggtctctcccacaacacttgggaattcaaaatgagatttgggtagagacacagccaaaccatatcaatggataaaaggaaatgtaatgtcaactaaagacaaaaaaaaaagaaaaaagaaaaaaaaaacttttgaagaattaaagttggttttatttagaagtcttattggggactgtagactgaggcctacaacccacaagcagtcttttacagaggttttatgagactgcgccagcacagtattttagcccactgtgtatatataggtgctaggggtttagcatgtgcaaagttatatgaaacttgtttagacattatattaaagtagaactacgttaaggtttgggtgtaagggtatatctggttctagattatagaagtgtcatcactaatctccccagatgttattttatgcgtaggagaaggtaaggactaggttcatttgtcttttaaggaatatagtgacttaggtaggagagatgggggccaggtgttctgttttattttgtcgttttggagagctgtatgtcatcacagagttggggctttgtgaaattatgttggcacagagacaagcaaacttagctgcttatgtatgtgattttgtctcacaagttctctctttaggtcacaaattaactctggccatatttataaaaacaatattgattgtgttatgtagctgagaaggctgttttttaggaaggttggtaatctttagttgtagttgtaaggaatgagtattgagcccagtgtgtatatttatttattcattggaaaatatgttttggattatatttatgttttaattactaggatttgttagggtttttgatgttgcctttttgggggttttgtgtgtgtgtgttttgggtttttttttttttcaatacagggtttcactctgtcccccaggctggagtgtagtggcatgatctcagctcactgcagcctccgcctcctgggctcaagcgatcctcctgcctcagcctcccgagtagctgggaccacaggcatgagccaccacacccggctaatttttgtattttttgtagagatggggtttcaccatgttgcctaggctggtctcaaactcctgagctcaggcaatctgcccacctcagcttcccaaagtgcaggggttacaggcatgagccaccatgccaggctgttgcctttttttttaatctaatataacattttaataggacattataaggatattatagattacatatagtagtctatatttaatagtaatatgatttatagattttgaaaaaataaaaccaataaaatcagaatatgcatttgtatttttttactaattgtaccttttgtatttatatttactagtattttttatgaaaagcaattttggactggagttgattgagaatacttttagagaagaatttggaataacaactgggttgtcttgtgcatttcctgtgggcatgatgccagccttgctcttctatggcaaaggatacaggttggcacatggaggagcttggcctctgcaagcccacagacctctgggctagctactcagcaactatgtgtcctctagacacagtaacttaatctctgtgcctcagtttcctcaactgtaacatggggcgaataagagtatgtgccgacagagttgtgtgcaattaaaaaaataatatgtgtaaagtacttatggtgggatcccacctgcagttcgcctccaggaaatgttagatgctgatgtggaggaggatgaaggggaggaccagatgtttttcctgctgctggcatattctgcgcgctgctcttccttctcccaaatcctttcagcagcattttctttcttcccgagattgccaagggaacccaggcagaatgccaggaactaaacctctctggaagattgacggaagaagagctgggatttgagcaagatagagcgggctcagggtcaccatgaggttcaaggtctgcagactcccccaagctttctctcgagtagatttgaacacacaatccaagtccaaatccaaatttaataggcttctgtactgagaattcagctcagccaattgtgttagagccttaatgcacatgggtacacacacacacacactcagtgcacacaatgagcactcgtacagggccgggtcacaaaagaagcgaatgtccatcatctcccttcacttcccctggtcttttctagtctccattcctcaccatttctactgaattctcccatccctctccaccttctacttctggaacgagctccaaacatagcattaaaaagcttcagtgtttccagggaacagagcattgctgctttccataaactggcagaactggtcgttaaatggaactttcaggcattcccccacattctgaagtcactctctatgtaatgatcttcctgatacacctttctgctctttcacctggaaaagaatttgaaggatgtggttatcagtcctctgatgatgccaatgtttcgactccatcctgaatattgttattgctgccaaaacctactggtaaagtaatatcaatagagccaccgtactaaaaaggatgtgtctgctacgttgttttctttaatatcaaggactttaactatattacagttaaaatcaatagaaatgtaaccttttcaaccacataaaatgagttcatttttattattattctttttctgctgttacagtgctgtgattgcaaaagcaaccgggtcaacttaagctttattgaaagaccattaaagaaacaaactcaaactcatttaaatactgaagctggtgcattaaaaagatcaataaagtaaaagcaactggggttgctttacttaaacaccccacatacgagaatcattccacaatcacaatttgagcaaacctataaaactaggagaccagccaataaagaagaaaacgctgtttcattactaggtttagacccataaagcccttaactttagtctgattagacatactgcatttaaattttctctcagtattttaaaacatcatccagcaaagacttattgatcaatgaatgtcatttacttaggaaagccattagctccctgagttaggggaatgactcagtggtagaaagtgcagtttcatttatttaaaaataaacacaagattaggctacagtgaagggaagttctagactcacagggagtcaggaaattttctttctatccttgctgagcgtggtatcttgaacatagttatttgtattcaattgaatgtttactaccaattctgtggccatggattagacacaaacctctttgtgtgtgcctcagtttccccagaggtagaacgcattaatatccttttctccctctttctctggataagaaaacaaaaatgattgacacaaacctcttcaagttcttccttaaaaactataatacaaactataaaccttagtggtaatatgtacttagaataattttagaatcagattggtccttattggccatgagtccaacccttgaccagtctctgcttatattactagttatggaaaacatgctatttttcttcttaaaataccatttattgtgtttttctaattatacatttaaatatatttattatagaaagtacagaagagaacacagaggaaaatcaggtttgcttgtgagtcccatttaaaatcagccctcgacccttctccaccaaacccgtcttgcttactccagggcattgctgagcagttctctgtcttcgttctctactgactcattcccatcagcaaataagcatgcagatatttctcttactttaaaacaaaaatttctcctgagaccactttccccacatctttgtttttctttgcaataaaacgcccggcaatagttatctatgcttgctgtttcgggtcagcttctcccattctctctctctctctctctctctctctctctatttatttatttatttatttatttatttatttatttatttttttggagatagagtcccactctgtcgcccaggctggagtgtagttgtgcaatctcagctcactgctacctccacctcccaggttcaagcgattctcctgcctcagcctccccagtagctggaattacaggtgtgtgccaccacgcctggctaatttttgtatttttagtagagatgaagtttcatcatgctggccaggctggtctcggacccctgacctcaagcaatctgcccacctcagcctcccaaagtgctgggattacaggtgtgaaccaccatgctcagcctctttcttcagtcaactttactgaaatgtaaattgcatgcaatgaaatttacacactttaaatgtacagactgatgagttttgacagacgtgcacacccatgtagccaccaccacactcaaaatttggaatatttctaatatcccagaaggttcccctgggcccctttcccacccaccattgcccccaagcatttactgatcaaatttctatttctataaagtcacagattagttttacctgttctataatttttttttttttgagacagagtcccgccctgtcatctaggctggagtgcaatggcacagtctcagttcactgcaacctccacctcccagattcaaatgattctcctgcctcagcctcccaagtagctgggactacaggcacatggcactacacccggctaatttttgtatttttagtagagatgaggtttcactatgttgaccaggctggtcttgaactcctgacctcatgatctgcctgcctcggccttccaaagtgctgggattacaggcgtgagctaccacgcccggcctacttgttctataattttaaacaaatgtccagctcctttcattctgcataatgattctgaggttccttcttcttgtcgtgtgtatctgtggttgtttttttaattgctgggtggtaatacacttatgaatatacccccatgcatttattcattcacctcttgatggatatgtggatcattttggggatattatgactacacctgttaggaacatttgcatacacatgtatagagcagacttttttttatttctttcaagtaaatatctaggaatgaaatcaatgagtttatggtaagtgtatctttaactgttttttgatgtaatattccctctaggaagacagcagaattccagtgactccacgtagtcactagcacttgatattgtcagtctttttaattatagccattcaactggtgtgtggtagtatctcattttgggtttaattttcatttccctgatgactgatgatgtttagcgacttttcaagtgcttattgaccactggtaaatcttctttcgtgaagtgtctgttcaagcctttggcccctttttaaaattggattgtttgccttattattatgttataaggattctttacgtattctggatacaactcctttgccagatgcatgtactgtgaatattttatcctcattttttcttattcccaatcccagctgggctgctgtccaccactgcttaaagctactcttatggatactatcaatgaccttctcaccaccaaacccactggctacttcacagttctcctgctgctccacttaaaggcagcatctgaaaccagggagcccttggcttttagggaacactgctcctgtcctccttctccctcatgggccccttttgctctgtctccttcactgtttctctccttcctgacctccttcagtgggcgtgcttccagtgctttaccatttgtattcactcctgtgatgatctcatccaatgtcgtgctcttaaattttatctctgtgcctcaaactccaaattattatctcaacccaaacctcgccatgaactgccgactcacacaccaaactgactcccagatatctaactgattcttgatgtctgataaacactccgaacacaatatctccaaatctgacctcctgatctgccccttcccacaacctgccctgcttatagcctttccaatttcagctgatggcaactccatccttccagctggtcaggattaaaaccttggaatatcactagaacatcactcactggttctcacagctcacatccggtttttcagaacctcatgctggttctaccctgaaaacatccaaattctgaccagcctcccaccttgcacatctgctgctcgggctccagactccatcctgttctgcagaggcctcctgacgggtctccaagcttcctcccttgcccttgcaggagcgtctctgacatcactaccccatctgtttaaagtacgagttctctgctcaacacccactgacagtcctcgtttctctgaggacaagccaaagtctttccagtgacctgcaggactccacaggaactagccccgtgaccctccccttttcatgctacttgagcctcactggcttcatgccgggaattctcccgccttggctgctctctctgcctgagtgttctttccctgggtttctgcagggctaacccctcgaatccctcaagtcttcattgaatctccttttctcagtgaggctaccctgaccgccttatttagggttgcagtctgacttttacaccaggcctcttattgggctctaatttgagggaaaagacttcgaatttatcccctcctaccatattacatcatttactttttctctgtgtctctctatactaggaaggaagcgatatgagggttaggatttggggctttttgttcactgatgtatcctaagtacctagaacagtcagttcaaggcaccttatgggcacttgacaaacgtttcttgaatgaataaacggacctgtgatgtgactacagattccttcccacacgatgcactcggaggcccctttcttcccacccagccagtgccaggcattctgcagcaacactgctccatcatcctcttttctctgcccctgcagattgacatcttcagctccctggccaccagattatggttgggttcagctagcagaacactgcaggaaaacacagggggaggcacgagagatcggggtctgtcctgtcctcacctctatcctgcttcttcccaaagtgctgggattacaggagtgaaccaccgtacccggcctcattttacttattatagccacaggttcaaatctattcatatttttgttttgctttgttttttctgctctgtttagagtcggagtctcactctgtcatgcagactggagtgcagtcacacaatcacagctcactgcaatcttgaactcctaggctcaagcaatcctcctgcctcagcctcccaaagtgctgagatgacaggtgtgcaccaccatgctcagcccatatttattttttaacccttgttctattattacctcactctctgcaaagacttctagaaccaactacttggagttaggccaaactttacagctccaagggcacagtcctccacaagactggtctcacgtcaaaccccagctgcaagcccaggggtctccaggtgaccctcatttacaagcagctggctacaaattcagaggttcccactactccctcaggtcaataatttgctagaatgatttgcagaactcgggaaagcactatacttatgatcaagttttactataaaggatacaatccagaccggccaaagggagagatgcaggtggcaagatttgtcccaaatgcaaagcttctttgtcctaaggacacactaccctccctgcacatcagtgtgtgacaatgcccagagtattacaaaccagggacatttactgagcttcggtgtccaaagttttttttagaggtttcattacacaggcttggttgattgaatcattggccacaaaggtgaactcaatctccagtccctctgccttatctggggtttgggctcaatgctcccaactctaattgcatgtttgatgaaaagaagggagaaggaaaacataaaaaccctcctccttacatgaatgcccttctctcctcagttctcatcactgctcttctagctagctttctcttggcccaaagtacacaaatggtggctccagcaggttccctattcctggacattttcaattctaagcagcagcctcaggcattggtgatcctattggatgatccagtcacatgttcttcctaaatgccaagggtatgattatgctacattgcttggaggagtgtgcagccttgcctcattctgcagaagttcccagccatgctgtagccccagttccatatacgtaccacagccaccaacacaggagcctgtagggcacagtcagaatccatcttctttacctcttgggttcagataaccaagcaaagttctcctccaggccattttcatgttctctctgtcttcaatacacattctcctatacatgcctcatagtcctgattaggttagcaggccctgtggttgagcagacttccaatttgggaattgaatgtcagtttcttcctacatttaggcccagaatcaccctactcttgcccaatgtctttgaactgtttcttcatccagatcttttcatcccttaatacattctttctctcaagaagaatatcagtttctcaaggagagagatcctggggtctctccagacacaccgacatgtgcttgagtcccaacgtagctacacatgaactaattcgtcagccccttagggtcttgatcaggtcaccttgagccacaattttcaccaacctttcctctctgatggaaatctgaagtcctccctgggatttccaagggttctttctgcttccaggtgctttcttctgtgggtgatctctctgatccagagaatatccacccagaatgaagctcagcacttcctttggttcacaaacacacaaccgcccaaagcattcactgagcagtagcctctattgactatttcagggtcggggagaggggtacacagcacattaacaaatcactgcaagtcatagagtagatattcatgccctcaatagttcctttacccatccttctatagaggcttctcatagcccttcacgccaggcagtgccagtctttctgctttcaccccaggcagtgccaggattttgatttctcctgattcatgctccctggctccccacctgcttcctcactcatctccaggtctcccccactattatatacaataacaagctgactcttcccaaaacagggtccaagcttgctggcccagagtagtcaggtgctcaacagatgcaaaaacttggatttgaccccctttaaaggagttgtggttacaaataacaacaacaatgagaatttgggggtgatcctatgccagaataacagagatagatagatacatagatagatagatagatagatagatagatagatagatagacagatgatagatagatagatagatattgattgatagatgaaaaactgtaaccccagttttgtatagatcaatccaaactttgcatcctagcattcaaagcccttcacaacgtatcttccatttaccttctattgtcttctaccattcttttccaaaacacatcctaaggaccagcatggctggtgtcgtctaccattttttttccaaaacacatcctaaagatcaatgaggctagtgacctcaacacccttagagaaatttggtttattattcctccttcaaaacgcctccactctgccaatctactgtaccatgatgacacttattctccatattacatattttagaattaggggtaacattttacatttaattttagtagattgtcttagaatattattccttcattgtttcatgtcatgttttccaaacaagaatctaaagcgccttgagcccagctgggaacatctgcacgtcatcagctggactccagtcccagtgctcaaggtggctggaccacaaaaccacatggaagcccttgcataatgttaggaggtgtcagcaagatgatttgagtcttacgccgaggcctctctcttcccacagggggtctgcaccacccccagcagccaagttaccctgtgacagtcattcatctgtgctctgggtggcccatgggatgagtgtactactgggcaggtgtaacttcaggggcacacacagcagacatccccagctgacatgacaacctactggcttctcaagatttgactaatcatatatagtcatcccacaatatcctcggggtatcggtttcaggacccccaagtacatcaaacctcatgcatactcaaatcttgtggtcagctctgaggaacctgcatctagcaagggccgactttgcatatacgcaggtcctgcatcccaagaatactgtatttttgatccgcatttggttgaaaaaaaaatccacttgtaagcagtgcagttcaagcccatgttgtttaagggtgaactacatttctgtgaggggatcatcttcaaataaagtccttgtttctgtaccagttacagcaaaggccctgctttgagaatttaacagtcagagtagccacccacttcaaaactgaccagtcccatccgtggcaagcagacgatgtgacatcaacggctcttaccgcaccaggctaatacagttatcctggtcgtagtttcattttactgaaggccttattaaagcgcccccacacaactcagccaggaattcaccaggaaccaaatttaaacaaatcaaaccccgaaaacgtgctcaacaattcaagattacagaagggaataaagacgaaaataagaaaagcctcaatcatatttgtcatatctccatcgtttctcataataattctcaaagttctttattcctttcatttatttaattaaaaacttaggccatgcacgttggctcatacctataatcccagcactttgggaggccgaggtgggcaaatcacgaggtcaggagatcgagaccatcctggctaacacggtgaaaccccgtctcaactaaaaatacaaaaaattagccaggcttggtggcgggcacctgtagtcccagctactcaggaggctgaggcaggagaatcgcttgaacccaggaggcggaagttgcagtgagtcaagatcgtgccactgcacttcagcctgggcaacagagcaagactccatctcaaaaaaaaaaaaaaaaaaaacttaaccataacattatacaatttaagcagcatcatatttgttaatatctattttcaaaagcgactcttcctaattttattgttttcttcctcccttttccacgcatttgtttgtttttcttcctcctagaaagtcatgttctaagttatcaaaatgtgtttttcctcgagctcttcagggaaaaaatgccatataaaattaattcatgattattttatgtaaattattatctaaagtactcactatgtgtaacggttaaagttgattgttactaaagtgattctaaatatgaaagtgtataaaaccatgaactattctcacactacatctcaaagaaatttgaaatttctagtaaatttcaaatttactagaagactagttcagatattgtttttaatgatttacaatcatcttctgaattttcatttgcaagtcaaagtcacaaaactaaaagtgctacatgttttctgaccagattctctgaaataattatatagtgcttgagccattgtgctataaatatctttgaaatcaatgctattaaagaaatgctatatcagctgtgaaatgagaatttctcctcctgtccgttgacatttacaaaaattatacgaacttattgatagaaaatccgtttgcttggtttctttttaaacatcttatgctttaaataatattcagtgtttttccagtaggtggagtattagtctagataaagtaaatcactgtgtgaaagctaattttttcttcctactattttgagaaatttttgatataaaacataaatcacctaatagtttcactaattcttttaattgcatcaatatggtatgatttcaattactctagaccttaagaggcagatatattttactgattacattaccataataacaatggcataatgacaatagcagtaagtacttattatacctctcattttaaaattgcttatcaagccattagagaaacctcctgacatctctgaaacagaaattacacaacaaagaaagatctgtctcttaaatcctttctctctcgagccttaagcatttctgggaaactgcgttccttgtgagttgaatattggttcaaggctgatgctaccacttccagtccaggaatctgagacgatcactacctctccctgggattctgcttccccttctaagtttgtgaaaagatggtgataaactacatctctgaggcccctccctacctgaaaatccccaaatgaacctgaaattgacaatcttatggctgaatgtcgggagccaagtctgccgagatgttttagtacatacggcaaagatggcacttgttatacggtctggatctcaaaatggaaagtgagagaatgatgcctttccagggcaggtggacgcttcctcccaccctccatccatcaccaaaaccggtcgaagttgaatagtgccctgaaaagacaccttcaagtggtaccctagagttgtatcttcacagatgattctgctcaaagcccccagagacatgggaaaatactattccttagggccatggtagcagaacatcttcaaagaaacctcacagaactggttcaacctcctcactttacaaatgaggaaactgaagtccaagaaggcttcctaacttgataaacatccatttaacacgtggcagagccagggcccatctcctggccccattctcatccccccaggccacctctcctctcttacactggaagtctagaagctggtttgcaaggggtccctgaatgaccttccatagaggacagtgccttaccgagaagaggaaacacatactgaaaccagccacttttctctttttgccttctcacagtcaggtgattcgggtttggagagagccccagctcccatgcgcaggggattttctgtcctagaaaggcttaggcacagtggattcacctggatctcttctagttttgcagccagtttttctttcttgctcttggaccggagagcccccagacccaggcgtaggcttaggtaaagggggctcaggagacaaatctgtctgctttggccctaggctaggccacctctggccttgccaacaattaattaatacattagttaattaattaattaagtcaaagtcctccaacgtggttgagcccagctggggactggtaataaagtgagtggtttagagaataattcccagaagaagcacaaattgattattgtatttggtgaaaggacagcagaagagcattctgggcaaaagatacagctggtctaaagccctgagcacacctgggagtgcacagtgcctccccaggtgtgagagtcaggtcacagcacaggggcaaggtctaggcgagggcactgcattctcgcctctccattctacgaagatgccccctacccctctgatctccccagggccatttaatctctcccaaagaggcaaaggctccctgacttatccatctgcagttacctgcaggattcggttaactttcccttcgtaaaggcatccgccgtgaaacacaccaggcacctccaggaccggcatgcatcgctaacccagtgacaaaagcatggctgttgctcgtttattccagagttctgttaggggagagtgtttcttggcctctttcttcttcttgagtatctctataagtcggcaggatttatgagtagctcaaccaaaaacaaattaaggtagacaacgtgacctctaaatgggtcagcctcccaaatggtgtcctctcatctgcacccatggctgttcttgggattggagggatggccgcagggcttggcaatgtaggttgggagggggctggcctgctgaccctcaccctgatgggcttgtggctctcagcaatgtggtcccaaaaacaagttgcactgaaatcaagactctcagagcagagcaggggcaagtgtctcttgcatgaaaattcggagtcccagattcacgatcagccagtctccccatcgatgtggtctgggaggatggagccaagctcactcactcaaactcgatgtcaataaaatgctatgagggcttcagtccactgagtcattcacagagattcctccctctacaaacagaagttctaatggaagtaaaagctaggaatccacaccttaaacacacacacacacacacacacacagacagatttacatacagatacatacacgaacatggctcagccagtgctgacccatttaacacatgttaaatgagcaccttgcatatcacaggcccttttcatgtggatcgtaaattaactggaaggtttattagataacactacagagaaagaaatagccgaaagtccagaggtgaggtgttagccacggagctctgacaaccaggtggatttccactgcacctgctgagcccactgatcagtgtttaacaagcgtgtgttatgccacgctcctggggcaggagtggtaactgaggcagcgtccttgaacccacagggttacggtctcaccaagggaggatcaggaacagagctgcaaccctggactagcaggagagtcacacctaatcctacttctttatctcccacacatctacatttgctccatgtcctctccattatcaggaacaaagtgattctagggttaggaaggggcagaaaacatttagatgaacgtatccttgatactggggtcaaggcctgcttgttcgtattttcaattgcaaatggccctaggcttgtgtatacccttcatagaatggagattccgatggggagaaagagatggtctccactcttcaaaccctctcttctttgaagtctgtgggaatttctagtttagaaggacgggtagacacagataaggggtgcgagttgagctgataattgtttctcctacctgaagtctatctgcatcagcctcttcttatcttcagccttgggcttcaacttggagtaaataaaacattcatcagatgatatgctctaggctgggcgtggtggcctacaatcccagcatgttgggaggttgaggtgggaggatcacttgagcccaggaatttgagacaagcctggacaacatagtgagaccccatctctcctaaaaataattttaaaaattagccaggcagccaggcacggtggctcacacctgtaatcccagcactttgggaggctgaggcaggcagatcacgaggtcaggagttcaagaccagcctggccaacatggtgaaaccccatctctactaaaaatacaaaaattagctgggcatggtggcatgtgcctgtaatcccagctacttgggagactgcagcagaactgcttgaaccagaacttgggaggcagaggttgcagtgagccaagatcacaccactgcacttcagcttgggcaacaaaagcaaaactccgtcttaaaaaaaaaaaaaaaaaaaaaaaaaaaaaagccaggcatggtggtatgcacctgtggtcccagctactcggtaggctaaggtggaaggatcacttgagcctgagaagtggagtctgcagtgagctgtgactgcgccactgcactctagcctggatgacagaataagaccctgcctcaaaaaaaaaaaaaagaaactccttagtcatacacctaaagccaatctctccataatcactttattgggaataaaatgatattttgaagaaaaaagatgatatattctaaattcaatatcgctgagctaattccaagtattccctaaaattaacgattaggaaaaacagcaagaaatcctaggcctttgtctaggccatggaaaaagcgggatctgccttgaaattgtgtccttcatctcaggagatggggcccggcccctccaccggtccaggagaacccacgccatttaggtatttcttctttagcttctccactgcatccccaaagcgtaaacggctgatgaaatcccttcaaactctgccaacgcaaactgtggcttaaaaatggaaatgaatggatattgcaaaataatacctgaatagacgttaaagctttaagctccacgtgtaagacacaaggtcctgcctaaatcagtatgcttctaatggcttcatggcaaatgttgaacaagttagtgttcactcaaggttgtcctggggtacatggagtcacagtctttaattttaatgagcctctattacacaatctcttatcgcctcttaactgccagtgaaatgaccaccagctaaatgtacagcaaaatacatttctacaaaagagctcacttggaccccaaagaaattaccttgaaattattacacttaaccgtggcaaatgcaccagggttcatttgaaaagaggtggccacctggcaatacgagtgaaatcatataatatgtcatttccttaggcttttcatgttaagcttttctcgctatatctgatttaaagtattttctcttttaaatgtaaatatttaaaatgtagctgatcctctccctctcctaattgaggtgactgggctagttcaagagactgtggcctgcagctcaccgttttgtctctggagtcagagtgccagccttggtacttactctgtgactggacactttataatatcaaagatacgagatcatacctatctaatatctattcaataagacaatacatattaaaagatcagcacaaagccttgtacacagcagttgctcaatatgtgcttcctcctttttcctactattgaatcccaccagccaagaccagaactatatctgcagttggacaaagttgggtttatcccttgttgcagtgagggcttagcagtttgagtcaaacgggagctggaaaccacagtcggttaaaatggggtgataaatagaagcattaactatggcaaacagcaactccaagatgtaaggaaatccgtgcagtttcctagtggccccctagggctgagggagcccatccagggacaacctcggtgggtgtctgaccgtaatggaggcaaagctgcccctgtctcctctgacagtctccagctgggcctgagagttaagttgacgtaggagagactaacagaggaaacgcaagccaatgtttacaggcatgtgagggccttcacaggacaccaagatccaaaagcagccaggcctaagtgcttatgcaacagggtgaacaaaaagtagtaattttgaaaaagtaactaactatatggagatactaaagacaagggttattttaacaagagctttttaactgtcaaaacactttttgtttgtaccgatttccctcggcctcaactccccgcctctggagagaagaatgttcttttcttcctggtagagagaagccatcttccatatgaaagtttcatctcctgctttcaggaagaaaaggggaggtcagagtgtcctttgtgcatctgttgtttttctttttttctttgagatggagtctcactctcacccaggctggagtgcagtggcaccatctcggctcactgcaacctctgcctcccgggttcaagcgagtctcctgcttcagcctctcaagtagctgggaccacaggcgtgcaccaccatgcccggctaatttttgtcttttagtagagatggggtttcaccatgttggccaggctggtctcgaactcctgaccacaggtgatccgcccactttgccccccaaagtgctgggattataggcgtgagccaccacgcccaacgcatctgttgtttttcaagtgcctttagctcaaaattgtccccatctcaagccagcatatctggaggtggcgtgttctgaagcccttcaggaccttgctggagaaggtgtgtctgcctggcagagagcagagacccctgcttagccaagctggagctggtccggaattgctgggggagcgacaggctggctgccctctggagtgcaggtgggggagcaggcaatagcaatggcggtgggggtgagagtgaggggctaccagggcggttcagacacacgtccagaggtctgtgggcaggttgccatggctgagacgctagggtcacagagggttctcttaaaaggcctgcgactcagacaggcttcacctcatgtcctcgcactctgggcagagcctctgctatccccctcctcgagcctgtgctggaaattgcagtaagccccttcctcttgcagtgtccctccagagcacgctactgagaaagcttgacattgtgctcaccttaaaagcaaaatctttaaggaattccattgtttatcatagagcttatattgaagggtgcattgggagccaggaagcaacgagttgattgataattgacgcaaagggacccatataccttagagaatgacggggtggctctaagagtcaggaagggcttattttaggaatcaggcttatggtggggagggttcaaggaagcaggtgtctctaatcaactgggtgctctcagaaaagcagggctaattcagttattgggcctcttaatgcatttcatctgggaggcaggaagaatggagaacactaacgttgttattgaagaaattgccgggagaaagagatgttttggttttgggttgtacaaggtctgttattttttaatttcttgtattagtttcccagtgttgctgtaacaaattgccacaaacttaaggacttaaaacaacatgcatttactatctcacagttccagaggccagaagtgcaaagtcagcgcaaacggctgaagtcaatcagaaaggctggtgccttccgcaggctctgagaggagaatctgtttccttgcctttctcagcttctaagagtctcctgcgttccttgggcccttcctcacgtcactctaacttctgcttccgttgtcacatcttctctccactgcgaccctcttgcctccctcctataaagaccctggtggggacctgagacccacccagggaatccaggagaattcccctattatcttaatcacatctgtaaagcccctcttgccaaggaaggtgacgcgctctcaggtcctgagaattaggatgttatctttgggaggcatgattccgcccaccatatctccatattcagacaaaattgcagaatggtctcgtgtcacatggtcaggtcctggagagccctgatccgatgctgctgttctgaattatgttcggcagggggacagcaccacctggtggtaacactcggcaaagcatccgccgtcagctgcagagctgcttttcctttggggtcctcttgctttaacccaccttccccacaatcccactcatcccttccggccacagcccgccttcttagacacaaggcaggcaggagtatgcgagagagaagacgtaaggacgccttgctcgtggtaagatcagagactgatcggagaacgctttcctccttccctcctttgagaatttcctcaggcactgcagcttcacctttgtgaatgttgaaggctttctggatatcctcgtcacttctcatattttcctaactgagcaggtaatttggattagaactgtacagcatgacccatttaggttcctgttcactgttttgaaattaatgacttcatcaatgagttaaggctaggagtgttcattatgttttttagaaaagtcaaaaccgagcaggatcaccgagaagcaagatgacacaatcaacaatcaaaaacctctgagtagaggctattactgtgtttcaaaacaaaatatataaaagtggccgggtgcggtggctcacgcctgtaatcccagcactttgggaggccgaggtgggcggaacacaaggtcaagagttcgagaccatcctggccaacatagtgaaaccccgtctctactaaaaatacaaaaattagccgggcgtggtggcgggcgcctggagtcccagctactagggaggctgaggcaggagaatggcgtgaacccgggaggcggagcttgcagtgaaccgagatggtgcctctgcactccagcctgggcgacagagcgagactcagtcccaaaaaaaaaaaaaagaaagaaagaaaagtttatataaataaatgtaaaatttagcatttttggttaaagccatcaaccacgcagacataggaagggaatacacttatagagatcaactaggaattttattttactgtagctcagcaaaaataatataaaatggctgccaaaaagccaaggccgtctagtctggatctgcagaaacaattcaggaaaaggaaggtacctccactgtgtgggtcatgccaaacctgaggacggatttcccttcggtgctcgcgactttaaaagttgcattaacaactgttaatgtcaattatcaagatcccaccatgtattgtattgggctgtattgggcctgaggacacagaaatgtaaaaacctaaacatggaaatttaatctttaaaactgtgtactatgtatccatagaacgaaatactagtcatccatgacaaatgatttttgttgtatatttattgagacagaagacattcataatatatcgtcaagttaaaaaatatacaaaacataatatgtgttagttgggttccatccctttttacttaaaaagttgaaagaatatacattaaaagttaacattgactatcagctggcagtttttttctgcaaatctatatcattttttctataacgaacgtatattacttgtatccatttttaaagctaagaaaatagaattttgttgtatttttatcgacacagagcgacattcataatatatcatcaagttaaaaaatatacaaaacaatgtgttacttgggttccatcccttttttatttaaaaagttgaaagaaaatacattagaaattaacatttattattagcaggcaactttttttccggcaaatctgtgtttttctataatgaacatatattatttgtatccatttttaaaattctttaagaaaatagaactttgttacaaatttagttttttgttttgttttttttgttctgagatggaatcttgctgtcaccaggctggagtgcagtggcgcgatctcggctcactggaacctccacctcccaggttcaagccattcccatgctacaatctcctgagtagctgggactataggggagtgccaccacacccagctactttttgtatttttagtagagacagggtttcatcatgttggccaggatggtctcgatctcttgatctcatgatccacccacctcggcctcccaaagtgttgggattacaggcgtaagccactgccctgatcacaaatttagtttttaaattgtaagaagtatgaggtggagattatcacctcctaaggcattgccaggtaggctattggttaacaatggcattttgcatttaaccatttaacaaaagagagtaagtaaacagaagtgcggtggcagttacccatgggtgtcattagatggcagcaaagcagctagctaatatttaagagcagaaactgaagagcttttgctccaaagaaacatatatatgagattttaaatatttaagattatctgaacggaataagtgtttttgtttgtttgtttgcttccagacagggtctcactctgtcacctaggctggagcacagtggcatgaccacagctcactgcaggcttgacctcctggcctcaagctatcctcccacctcagcctctcgagtagctgtgactaccggtgcacaccaccacacccagctactttttaaaatttttatagagataatggtctcactatattgcccaggctggtcttgtactcctggactcgagagatccacaagcttcagcctcccaaaatgctgggattacaggcatgagccaccacacctggtttgttttgttaatgatgcatttgacgttatagaaaacttttcaaaatgatagccaagcatgcaaatgtttactttaatagtttttgggggtggggtgcttttggatttttgtggcaatactactcatgcacaaaaacctactgtaccagttctgtgggtcaaaaatctaaaatgttcttgagatgtgaggaccctttgactcttaaccgtgactgtgcaatgatctctaagtttctaggaagcagtttcaagattctgctgcagacagtcattaataatgaatgactattcatcgtagtatgatgtggtgatgccatttgatcacttgcctgccctctttcttcactgccactctctccttcctcccaagagcacagctagcttccagcatctttgctcatctgaaggacagttttttgcctaatcaggcccagtttgagcaaggactctggatcgtatctgcttctgagtctgtgctgctgccttcaacaagttgctgcttgttctgtctccttcctctacacaattgacgtggcccccatgggaatgcccatgtcggaaagcaatgctgtgctttcttataacccgcacctctcgtcatgctgaccttagcacgtattaaactcacttcagaaaaatgaatgcttacaaaagaatgttttccaccggggtggggggcccaaaaaaggcccagaaagctctaagagctcacagttggagaaacacatctagactgtataggtggtaaaaagacagctgagaagataaggcaggaaaagccacacagggacacaaagggcaaggccagtgattctgacaccaccattggcactttgtccacgggcaacaggatcagaaacgtgcgtcgcttccgtggttactgtctgtgcaccgttcccaacagcttcatttctctccctctgctgccaactcgcccaaccacccctgcctgtggcaggagaaatcattctcattgggataaccgagaaaactacaactgtttaccccacttgaccctcagcatttgagtgtgtgtgtgtgtatgtgtgtgtgtgtgatcatgtcacaaaataaaatgtttccgcaaaacttcattgctgtagatgtggcatattccctatcagaggctgacactggagattggatcaagcagatgttactccattaaaaagaacatggatcttaatcctgtaggtaaatcatccacagaaaatgtacatcacctggagagccgttcataaaggatcttcacttaccatcctcagattttttcaaagaaccccagcaaaggaagacatgggtttccattttctcggggtggtgttttagagtcagtgctgatgaaataagatatcagaaaaccagggttcaaagagtgatgtcatccccacagggaagatttggttccacacagggtagagacgtgcttctaaaagtgtctcttgttttcctcctgcagctcgatcattatccttctgtgagttaccatctgccaagttcatccgacaccctcttcaattctcccaagtcgctctttctgggaaaagttataggtaagaatgtggttcgttaggtataaatgcgtgctacaaatacatttgggtaatgtgagtttggattttaaaactatcaggtaaatttctcttactggggccagtcacgaatatcttctctgtacaggaaagttacgtggttgttctcggtgttgcacaagcaaagcgtcaacaaattatctttgggggaaattgctcatgtaactcattctaaagctaattcgcctttgaaatacattgtgattaggctgggcatggtgggtcacgcctgtaatcccagcactttgggaggctaaggctggtggatcacttgaggtcaggagttcgagaccagcctggccaacatggcaaaaccccgtctctactaaaaatacaaaaattagccatgcatggtggcaggtgcctgtaatcccagctactcgggaggctgaggcaggagaattgcttgaaccccggaggtggaggttgcagtgagccaagatcgtgccaccacactccagcctgggtggcagagcgagactctgtctcaaaaaaaaaaaaaaaaaacaaccaaacaaacaaaaaacacattgtgattggtaatgggggcttctaagtcagcgatggtaatggaacaaacgttgtttggtgcgtggcataaactacaacccaagcgaaggcaaatctgctccaggcttctctatgtagaatttggtctattacagacctctacctactagcaatatgtaatttaacgtttcctttgtcaaagcatatcaacatgattctatcttcctctcactcgtaagaaagcaccttgatattatttgcagataagaaggccaataaggaatttgacagtgtgacagaacacccttccccatgtgcgactgtgaattccagagtctccttgtccctctcttcaccagaggagattagcactgtgcaaagctaaaaaatgtaccatgagccacagatatgtgaagattacaccctaaatttttaaaatatcgatatgattggtgaagtattttaaaatatttaatgtgaagccaatgaattttgttcatatgaggctgtgtactgtgaactgcaatgaaaacagtaagatggtggtgatgtacaggtgggagggaggtcactcggcggccagtgtgtagaagtgatcagaatagcattaatggtaaaaatgctcacttaaaaacatgcggcaggggtcacaaaatgaggagtgagtaggagactgaacctataataaaaataatagactgggcgtggcggctcatgtctgtaatcccagcactttgggaggctgaggcaggcagatcacgaggtcaggagatcaagaccatcctggctaacacggtgaaaccccgtctctacaaaaaaatttaaaaaaattagacgggcgtggtggtgggcgtctgtagtcccagctacttgggaggctgaggcaggagaatggcgtgaacccgggaggcggagcttacagtgagccgagatcacgccactgcaccccagcctgggcgacagagggagactctgtcttaataataataataataataataatgtgcacttatgtaagatttactgtaggccaggctccagtttaagcacttgacagatattagcccattcaatcttcgtcacaattgtatgaggtagttaagattatgatctccactttttagatgagaaaactgaaccatgaagagattaaataaccgggccacctggctaatcagtggcagaaccaaaatttgaactcaggcaatcagacaccaagggagctctttactgtgctgtaatccctgtggcagttaatctagaatgcaaagagaaagacagagaggaaagattgggcaggtgataaatgctgaggctgtccaggtaagggataaagcctatatcttgtgccaggaagtggtcaagaacaaaaaggattcctgggtttagaaccaggaacacaccagtccggctggagagggaggcatccagaagagagggggaaagcaggtgtgtgcatgaagcccaagaccacacacctggtgaacaagacagtggggagtggcaagtgataaatcaaagggtggaactggaaaacaaaagagggctaacatgtattgatcactgagccttagatattgtacgatatgaaagataattaaatagcttctgcttaatcctttgcatcctgaaaacagcactcaggcacagtctcaaatctagctttggattacctcaccctgatgtccttatctgaattttctccaacactttctatagttgatgtatttttacagatcttatcaccacttttatgttctgtgaacaagaagagactttgtgacatcacatgttacacgtgtaaatataagaaacaaacgtcacaacaatccaatgaaatgagatccctgattatgaacctcattttgcagatgagaaaactgaagcagaagaaggtcaatttgacaaaagttactcaactaatactggcaaagcagagtttggaagcgaggtctctctgaagacagtccagactcttaagtgggtcaaacaatcttgtcattcatggtgaagctccagaagagggatgtatttgaaagttgagcgatgccatcagttagcaacaaaaagtggctgtttagtggagtagggccttggcattcatgagtcatggatctgagactttggtgagtacccgctttctaccagaggtactcccacggttcagttgagaatactttaaaatgttaagtgctccttcagaaccatatgattccatcaaaacaaacgctacactatgatatggtgatgttcctaaagatactacactatgatattcgtaaagtaacatcaactataaacatacccgaaaataatagactttttattactttgtggaacctgcaaagtcaaattttgatgggaatgttggatgatttctaggttctgtcactatgagtaatattctctggttcctctgttttccaggtcatgtaactagttcacatttcagcacaattccaatatactgtatggcatggaccttcaaggtcgtgaacaaataacatcataaaggccacattttctacaactaagaatgtaccttgacatcaatctgtgcaaagctaaaagtgtaccatgagcctcagatacatgaaggttacaccctgtattttttgtacacccaagaaaaatgttgctgcatacacaaactaggtaactgtgcatgtggcagtgagttacagaaagtacacataaatacctgtaaggaggtccacaattccaagatggaaatggtgttatgcaggtgagagtagttagggctccagcaatgggtccttggtgcactgacttctagtggagattatctctcatccctacaagcctgtgacctccctgcagaccaagaaagcatctcatagttccaccatatactaacaaggagcaagtgctcaataaatatttgttgaattaataaagagtaaaaggggaaggaaacagaaagatatcattgtagacgtatactgcagggtgaaagggtatggatgatcatcctaacagaatcagtaagattcgcacagaggtgagagctgcaatcctcacatatctcacagcctaaaagtaggcatctgacgatcatgaagtagaaagaatgtggacttcggaatcaggcagagcttgttagactggaatccagttctacctctgttagcattgaaatcttgaccatgttgctttcttagttgaacctctcagagcctaggttctctcctttgcaaaatggggaacacaaatgcctacttgcaggttgttaactccctgagggcagaaggcagagactttttttgaaactaatctatttacagcaggctgatcagtgcctagtatacagaaagggctcaaaaaatacttgtggagtaaatgaactactcttttaatattaagctaataacgtcttaagacatacacaacacaatgcctaatacataaataattaccatttttgatgctagctacatgccggttattatgctatatgctgtaagtacaatactgtctgcgtttctcacaacaccacagaccattgttaccctcgttgtatagaataaggagctaaggctcaaaactattaagttttcttcttaaagtggggtttcccaacagcagaactattgacattttggatcagaaaattctttattatggggctgtcttgttcattgcagaatgtttagcattctccctggcctttacccactagatataagtagcaccccaagttgtgacaaccaaaaatgtcttctaacattgctaaatgttccccaggagggaaaaattaccaccccagttgaaaaccacaggcttcaagctactcagcgagtcagcggtgacgctgagatttgaaaagcgtgatttgtgacctaagacctatgctttgcttcctgatgacacctgcaccttccagaatggtgaggaagcaaggacgaggttcttgctactctgaagctaaaattctgttaataaaattgaaggagtctcagtgaagaccccaagaagacatgtaagtgcttgagaagctaatcactggccaccccttcaagccaatactcctttgatatttgatcatttcacaggggcaggaatatgcttaaatgtctctttgaaaacaacatatacttcagtgagagacaacccatttgcattccccagttgtgtaaaaatccatctgtacagacatacagtattgaacttgcaactgatatgtactccggccaggttttgaaaccccctggagtttcatgctccaaagttgttgctttacttttataggatcagtttctgctactcagaaactgattctataaaagaaagagaagaagatggctctaaatacctaaaatgacttcacactgagctctttgatgagcactcctcaaaaagggacacagaaaaaggatgaaagaaaggctacctaatcaaggacaagtgtgatctttataaaggggatggaggatatatattcaagaaatagtagtgtgatcactgccaaccaacagcaaacttttagaacggattcttacataattctgaatgcttctagaaggaattcagaatcactagcaatcagcaaaggttcacaaaggagaaatctcactagacatagttatgtccatctttcatccctcatatccatccatcttttaccagccgagtgatgtcatagactttatctttcagcaacaaatttaatggtctctcaagaaatcttcaaggaagagaaatataacttgaagccgaaagtggggtgttctgtttgctcatgtccttttcaacatctctattaatgccttggagaaagacacaagtagcatgtttattaagtttgcaaatgtcacgaagctgagagggatggtttaatatgatggattataaaaagcatttcaaaaccatcttgacaggctagaaagatgggataaaaataataagatgaaatgtaatagaaataaacttaattgcagcacttagataaaaaaaatatatacaatcacctaaatagaagatgggagacccccagcatcatgaaaaaacttaggaaattggtttgatggaaagtctggtacaagcaatgttacatggtgatggattcttaaatgaatgtgattctgagccacactagtatgagaatcatgtccagagcgagggtattagtcatctgaggagaaaaccagataaacacaagacccgtaaaggaaatgtcagaagacctgggaatgtctgatcagaaaaaaatatgatttgagagacgagagaatcaattttcagtctttggtaactgccacatgcagggtggattagacttagttgaggcttactcagcaagactgacatggaccaaaagcagaagatatgaagaggaaaatctcagctccatataagaaagaacttcctaacaattagagcttttcaaaagtgagtggtctctactttgaggtaatgaactctctattattgagaatattcaacaaaggctaaacggaaatgtgccctgtatattaaggagttgtctggattgagtaaaaccagattagatatagcctaaataaactttgaaactttaagatttgtggtgggagtaattttcttaattaaaaaggtgaaaatgcaatattatagtagagcagggtctcctgttccattggcaactagggggataacatttagggttccttgatataaaacactgttatgatgcatgatgatagatatgaatttagaagaatatcaatgtacagcgatcaccacatcactgtgagttgtgtaattacatacacgacctgtttccaaggtggcaatatgcattttaattttatttctgagccctctttaattaatcgtttttcaaattaactatttctgccatcgctgtaaatcagagtaatataaaaccgtaatgaagtagatctattctgaaataaaaagacggtagcttctctgtgtaaacttgagaagctgtgcttagaaagaagctgaatactaatgcagtgtcgttgttgcttggctgatcattgctgttgtcagtggcgatgtctggggtggtaaaaataaagcgaacttctatccatttgaactaactagagtttgtaagtcatattggtctcagatcctcatatttcccaaactaccattatccaaagcaattccaatagaagtggctagtagcccctatattatttctattataatctaaattgtgaatatcatgatcctacacgactttttattgattaaaaagtcttattctaaggctttctaaaactttctggagctttggcaaagcctcttcacacagaaggaactgacatacttagatcttcatttgttggtgaaatcatatactgtgataaccatgctgctcacagaatatttctggccagagttatgaatggaaaagatttgtgtgatttccaggctagaacatttaagtgctcatgcaagaccctctagagtccttttatccctttggcatggtgactgacaagcctaagacagtgattttttccgtaagcctgggtccctctgtgactacagtgaacagaaaactcttgacttgtgatgaacatatagcatgagataaaaaaaactccttgctttgttaagccaccgagactatagggctgtttgttactgtggcagagccttggcctgtcctgactgaggcataaggactgacttaagggcagactttgctctcgcacccttgggtttgatctctgatatagtttggatatttgtccccaccaaaatctcatgttgaaatgtaatccccagtgttggaggtggggcctggtgggaggtgtttggatcatggtggtggaagcctcatgaatggcttgggccatctccttggtgataagtgagctctcactctgagttcacacaaaacctggatgtttaagtatgtagcacctccccccaacactcttcctctggatcctgcttttgccatgtaccctgcctgctccaccttcaccttctgccataatcataagcttcctgaggcctccccagaagcagatgccagtgctgtgcctcctataaagcctgcagaactgtgagccaattaaacctctttccttataaattacccagtctcagatgtttctttatagcagtgcaagaacagcctaatacaatctcttactctaccatttgccgattgtatgactttgtcgggttacttaacattgtgtgtatctgttttgtcatgtgtaaaataggaatagtaatggtctctgtgtcacgggattcagcaaaataatacatgtttagcggttagcacagtctctgctgcatagtatgtgtgtaatacatattagttttttactttgcataatcagcaaatgtatactcatcatatgtcagatgccaggcattgtataagtccctggaacatcattagggtccaagacaggcacagtttctgcctttggaaactttatatattcaaatccagttctcagaggtttctcttgggagaacccaaagcaagataggggatcatacaatgtatcaatatgcactgggtcacatctttagagcttcagtttctggaaaagaaggtaatggaaagtcaattagaagtaaaaagacaagagggtgggataaatgaaaagaagtatagaattctttgggagcaagtagggagggcacttgagccagtccaggagtgagggaaggcatactagaggaagtaacacagaagctgggaccctaatgaagagttagaatgatctgggtaaagcaatgggctgaagtagaggccataagggcgggggaggtcagttctccattctgcacagcagtccacccaaaactgtgtggctcaaaacagtagtttattatttctggcaattctgtggattggcagggtggttgttctgcttcatgactccaggcagggtgtaagaatgactggatagcccgaaatagcctcattcatgtggctggcagcaagtgctggctgcccaggagctctttggggccacgagccaggggctgagttctcccccaagggttccaaatcatggctgcttgggctacctcatggcatggtggctgggctccaagaaggagctttccaaacagcaaatgtagaagctgaaggtctctaagagccaccattcttgccatatgctattgaccaaaatctgggttccagcccatgttccaagagagaggaagcagaccctacctcttggtggcatcgtagccaggtcacattgcaaagaaacatgccatgggagttacggttgtgacatctttggaaacacagtgtgctatgagagaaatttgaggaaccacaagttgcattcagaatggtggaaagtcggatgtgaagatgcaagtgataaaaatgctgcagcataagcagggttcagatcaaaggcggctttaccagcagggccacatgtcctgctttgcctgggacagacccaagctactcctgccaggacaagagtacattattagcagtgcccacttttactctaaaaataggactacgcagttgtatgatcacctatcttatttgggtgttcccaggagaaaccctgcagaattcgatttgaatataagaagtttacctgggagacaatcccataaaacaagcaggaaagtagagacatgaaacagggaaagggatggagcattatcaagccactcaccactgtgggcacctggaacataatcccaccaggacactctggaagacagtgcgagacatgcctccgagtgtcccaaccaaggcaggaggaagccagggcatctcgccacctcctcccatcctgcagtgatgagggctgcttcctgcggtactaactccccagcacttccagcttgtcccgtgtttacacccaacacactgctgaggccagaggaaagtgcagatgacagcgaatcgcagtcagtggttcctggagcaggactgaggtgaatgccgggcactgacagcatctgccatattacggatctatttataagccatgttaaggttttaatgttatcttaggggttaaaggaagtcaaggaaggatgttttttaatccatagaataacgtgatcagattgacactttagccagataataccatctgcagagtgcaaaatgcataacaggaagtgagaagctgcagggagaccaaattggaggttgccatggttatcacagaattgcacattgtaatgcacaaagcagctcacatatgtggagaaaatgcaatgtctttatctgtgtctgatgatgtcgtattccttctgggtagcaaaggcaaataagctaaacatccaggctggtttaaagctgattctgacttaatcatttcaaaattccttcctggttgtgctctgtccctcatgaataaaaatgttcagtttctcgaagagcctttcccgtcctctgcttctttctataaggtggggaccaggtgtacagaatataaaaggagacaggcagcaacatgtctagctttagcattctaatgataccgtgggcagggagagacctggatgcatgctggtccttgagtttgcatggccaggcatctgctggcctccagcccagtgtcctgtgtccctgagtgctcttctggccttggagcttaaatctgtggttgatgaacttagagtccctttctttgactcaggcagtgttcccagggagcacctgccatcctgccctttgcttacttgctgtgccctcaatctcccacttgagagacccctaagccctaagtctctttcgcatcctccgtctccccatggcaggttgtcgtcagctatcaagcagtgagggctttcatctaaggcttcatgctgcacgagaatgagatgatgcacgtgaggaccagagaccctgtcggcttactcttcttccctctctacatgaggcttggctgccccatgttagtacaggaccgccccccaccaccaccgaccccctacacagcaacctctccccagagccccagactgggaagcaaggcaagagccctaaacccttggtcccatccgtcatcctttagaaacccacttctgctctctgggccaaagcttagctctcgtctctcctgctgtatctcctccttttctcatagtcttctagggcattaagaaagaaaaaagaaaaaaagaaaaaaagctttgcttttacttcctacaaaaaaaaaaagcaccatctaacaaatagctccaaaactcaattgcttaaaacaacaattctatttttatcactaatctgcgggtcagctaagggccgaagtttctcttgtacacctctcgtcttcctcctgggaccagggagttagcatgggcatgtttttctctggcagagacacgagagaacaagccactcacacaagcactttccaggcctttggtcttgtcacatccactaacatctgattatctaaactaagtcatgtggccaaatccatagtcgaggagaagagaaacttgctttcccttcagtgaagaaaacagcaaagtcacatggcaaaggccacggatacagggaagggtaaagaattaggggccgccaatgccatcttccatacttaggaggtggatgcaggagaactctgtgacctcctcgatgtactaaaaagcctgagtaggcccggctcggtggctcacgcctgtaatcccagcactttggaaagccgaggcaggcagatcacgaggtcaggagattgtgaccatcctggctaacatggcgaaaccctgtcgctactaaaaaatacaaaaaaaaattagccgggcgtggtggtggtcacctgtagtcccagctactcgggaggctgaggcaggagaatggcgtgaacccaggaggtggagcttgcagtaagccgagatcgcgccactgcactccagcctgggcaacagagtgagactacatctcaaaaaaaaaaaaaaaaaaagcctgagcaaaggaacttggggaaatcattttattcactcaaaagtatgttcagtgctcacatgtaccaggtgctaggcacagaacaatggataaaacagaaatctcttatctttatgaaccatgtactctcatgagcatagacagaatgagaaaagagttgtgtaatataaatgttagcaataagtgctatgaagaaaagtaaaagaggcttagcaggaaagcatgttacaatggccaggaaagtcgtctttgagaaggcaatatttaagcagtggccttaacaaagtgagaaagctggctgtgtggacatctgctggaaaagccttccaggaagagagaatggcagtccaaaggctgtgaggtagggacacgcctggcttgttcaaggacaggaagaaaaccaacatggctggaatacagccatcaagggacagagtggcaggagacagatgaagtcagagggttagccagcagccaattgcacagatggagaccatcatggagagtctgcattttattctaaatgagatgagaaacagtagaaggttttgagcacataagtaacacaatccaatttacatattagaaaggtcattccagctgtgggatgctgtattaactgcagaaggggtgggctgatataggggcaggatggacactaagagaccatttcaaatacagttgtggagtccatgtgagagttagaggcacgtgcaccaacgcaacagcagtgatggtgatggagaaatctttggactaggaacacactgaagtcagagcccatagtatttggtgatcaaccggatgtggtgggtgagagaaagagaagtcaaagagcgtttcccaaggtattggcctgaatagctggcccagtggtggggctgcctactacaatgaggtaccctgggagagaagtagtttaggaactgtggaataaaaattaagacttccattctagccacattcaaggctattccatggatgcatagcactgaggtgcatatcagaaaccgaacaccacctgtaacacggccttttcctgtctttatctcccatctcctcctcaggcagatagatgtcttggcttgactaggacattgatcgttactgggaaaggcaaaaaagaaaaaagcctattgataaatgtcagaatatatctccattataaagtcattcaggtgttgcatatgaacgcaatgatgaagaagaacaaattactgatacacaaaacagcttggatgaatctctagagaatcgtgccaatggaaaaaaagccagtcccaaaaggttacatacccaatgatcccatttatgcaacatttttgaaatgacaaaattttacaattgaggacagattagtgagtgccaagggttagtgactaggacaggagggaaggggaaggaagagaggtgtggttagaaaaggaaaacaaggaggccgggcatggtggctgactcctgcaatctcagcactttgggaggctgaggcaggaagatcacttgaggtcaggagttcgagaccagcctggccaacatggtgaaatctgtctctactaaaaatataaaaattagccaggcatggtggcccatgcctgtagtcccagctactcgggaggctgaggcaggagaattgcttgagcccgggagacagagaagttgcagtgagccaagatcatgctactgtactgcatctaggtgacagagctagactccatctcaaaaatttaaaaataaaaaagagagattcttctgcagtgggaattattcattatcctgactatggtggtggatgcacagacctacacagatgataaaattgtgcagaatcacatttgcacacatacaagagtacaaaatctgaaataagatcattggatcatatcaatgttaatatcctgatggtgacactgtactcctgatttgcaaaatgtctccaatggggaaactgggcaaaatacacaggggatctctctgtacaatttcttacaactacatgtgattctacaatggactcaattaaagtttcaattagaaaaagcaataaaaagccgggcacggtggctcatgcttgtaatcccagcactttggaaggctgaggcaggtggatcgcctcaggtcaggagtttcagaccagcctagtcaacacggcaaaaccccgtctctactaaaaatacaaaaattagccaggcaagatggcgggagcctgtaatctcagctacttgggaggctgaggcaggagaatcgcttgaacctaggagacggaagttgcagtgagcagagatcacaccactggactccagcctgggcaacagagggagactccatctcaaaaaaaaaagaaaaaagaaaaggaaaagcaataaaagtaaaagaagaccaagtccaccttcttctgtggagccatttattcatgggatatttagtcagtgtctcctaggggctagtgccatccaccctgggggagcgtgagggacaggagagggacctgcagcgattaagccaccggttctacccattccctctttactttcctgcgctagccagtagagattaggaaatatgtgggaattattatttatttacagcttagaattttgtagttcttttagagtcattattgaagagaatgattaatataatacatttctttaaaaaggagctagagaaaatggggtagattaaactgcctgcaacttctctcaaggaaagtccccgatggcagcttatcgccttgtgatttatctctacctcctaagagtagaatgcagcaaaattgataaatgaacaaatggcaaatagttaattgaaatttctggtcagttgcctttgcgttttactataaggacagaagcagcaggaaagcactgatgagaaagctcattgaagtgataggtgagaaataatatttaaactgaagagaagaaattatgtcctgtttttcatatcctaaagaacatatagcgtagtcttaatgtccagaatcttctcaaggctgaaggaaatctattttaaaagaattcactcagggagttctagttcaaggctggcttctcattcttttttaattgcattgactttcattcttagacatttattgggctttattattattattgccttatagaatcataggaggccctaagaaataatttgttgaaactttgtcacattacagctgaggaaaatgaggcccagaaaggttaaatgaagccaaggtcacatagctggtacttcacaacgtttcctttttttttttttttttttgagacggagtctcactctgtcaccaggttggagtgcaatggcgtgatctcagctcactgcaacctccacctcccgggttcaagcaattctcctgtgagtagctgagactacaggctcacaccaccacacccggctaatttttgtatttttagtagagacagggttttaccacatgagccaggatggtctcgatctcctgacctcatgatccacccacctcggcctcctaaagttctgggattacagtcataagccaccacacccagccttcaacgatattttcaatataatatactgtcaatatcagaataatctttgcttatcacccaaatgtgtctttaacaaggacaataaataattaatacatcataacctgcaaacatactctcaatatctagataaaacagctgcaaaggcaaatcttgtcataagtgtaggctggaagaggatattttgaacattgagggtcaggctcaatacaggctctgtgtcagaacacctgcaattccagttgcctcacctgctcgaggagctttaacaggtttcttacaaatctcagcttcagttttcttaaccgtgaaatgagaatgatagtagtgccaatatcataagctttgttaggaagatgaaagatgctatcatgaatgtaaagggcttatcacacagcctggcacacagtgagtgtccagtacgtcttaggcagtatcattacatctaatctttgacttttagctaatacaaataaagaatggctgactccaatcctgggtcactcataaaaagaacactcaaacaatgaaaaactgaaaaaaacttttgattgaaaaccaattggtatcatcatctttccatggtttccaaaattaaattatttttaattaacaaaagcaacccccaccaaaaaaaatcatttattgttaaaatgtgatgagagatcagaagttctgttttaatcacatttttagtatttggttaaagaagattgtcaaaacacttatttctgtcccaaatcttcaactcacctgtctttgacacacaacatacttttgcatacccaattgttttgaaataaacaaacatttgaaagccaaaattctaggctgggctcggtagctcacacctgtaatcccagcactttgggaggccaaggcaggtggatcacctgaggtcaggagttcgagaccagcctggccaacatggtgaaatcccatctctactttaaaaaactacaaaaattagccaggtatggtggcaggcacctgtaagctcagctacttgggaggctgaggcaggagaattgcttaaacccaggaggtggagttgcagtgagccaccaagatcatgccattgcactccagcctgggcaacaaaagcaactctgtctcaaaaaaaaaaaaaaaaaaagaaagaaagaaagaaagaaagaaagaaagaaagaaagaaagaaagaaaggaaggaaggaaggaaagaaagaaagaattcttattattataacattccaaagtattccagaaggcatggaaaatttttgaatttcttatttatatacagttgatcattattattatacatttcatatttacaaattcacctactctctaaaatttatttagaacctcaaaagtagtattcttggtgcttttgtggttatttgcagacatgtgctgtgcagcaaacaatttgtcatcaatgtgtacattctcatttgaagtcaaacaaggtgatgcccttgccttctagtttcagctcttataccataaacaagtatcatttttgtagtctattcagtgccattttttttgcattcttgtgtttttattggtgattttactgtataaaatggcccctaagtggagtgctgaaatgctatctattgctcctaagcacaagacgctgcgatctgtcctgtggagaaaatacatctgttagatgagctgtctttaggcatgactgattgtgctggcagccatgagctcaatgttaataaatcaacaacatttatttcaaaactgaatattaaataagatacacacataaagcaaggtaatgtattggttggttgataaaatgttatgaccagatgcttgcaggaacctaaccctgtatttactttaggaacaatgttttagtattcactaattgagtgttagcagcaactgtatgaaacatagctactgcaaatagtgacaattgactgaattatttttaacctgcatcacatgaatatgatgatacattatgtttttatattattttgcagtttaaacagctcttccacagctattatcacacatgatgttcatggagcgttacagtttggctgtgtccccacccaaatctcatcttgaattgtagctcccataattcccacttgttgtgggagggacccgatgggagataattgaatcatgggggggtttcccccatactgttctcatggtagtgaagaagtctcatgagatctgatggttttataaggggtttccctttcagttggctctcattctctcttgcctgctgccatgtaagatgtgcctttcaccttctgccatgattatgaggcctccccagccatgtggaactgtgagtccattaaacctctttttctctgtaaattacccagtctcaggtacgtctttatcagcaaagtgaaaacagactaatacatggaggtaagaggagagtggttactgctcagcacactagattaacaagtccaactaaggctacccaggtagagcctggtcttctccttctggtttgtgaaatctcatggtgcttcctatagcataaagactggctgtcactcaacaccactgcatcttaaggtccgtggaaggggaacataacatgtttcgaagaaaaaggtctgggctacaaagaccctttatgtaatcttgctaacgacctggaatttaaactttggagagcttgaaggttaacaaattggaataaaaagaaatcaagtcactccttgtttgaatgctctgaagaacaaaacagaaaaacacaatgaaatggtaacagaagaagcagatttggcccaataagtctatgctttgaatgttcctccggcactaacatggccacatttgggaagactggcatccccacagacttttctgtagcactttgaaggaagaatagagcagttgtagaaaaacaaatgtttgcatgaaagaattattcacctcttaaaaatctatagggtgtgaataatcctgctataaaaagcattaaatgtttataacagatatttaatgggactgttatgttttttggcagcaagcatggctagattttgaatgtcacagctctgtgctctggtgataagacagactctgtggtctaagtaagaattattttcctgcttttaaatgtagctgttaaaaaacaataaagtgtatttatctaaggaagataatcttctaaaagaagtgtttaataatttttaattcacaatttatactacttctccaaggtaaattcattttccaactgttactccatctttattgactgggaggaattagcattcaaaatacaaactcagaggttaaagcaaagccatacacagaagtgagccttattccattgtcttttatcacgggtgccagatttatttaacagactgtctttcagtctcacttacagtaactagacaggtactatggaggacagtgtatgttgaatgccttccaagtgtgaaacacctgcctggcactacattatcactaattctaaccttgcaagtaagtgcctacttaaatctgcacttgacatgtgaggaaagaggctctgaagttttaaagtgacatgtgccaagtcatatagctagtaagtggtagaaccatgattccagggtgggtctttctgtgcttgttggtttatttactgtctgtgtttgttttatgaaagagaaaagaccctgagagataggcatagtacaggtgacccttgaacaacaggagaattaggggtgctgaccccctatgcagtcaaaattttgcatacaacttttggcttttcagaaacttactgccaatagcttactgttgaccagaagccttactgataacatgaacagttgataaagacatattttgtatatgtattatatactgtattcttataataaattaagctagagaaaagaaaacattattaggaaaatcataggaaagataaaatacatttattattccttaaatggaagtggaacatcataaaggtcttcatcctcatcttcttcacattgagtaggctgaggaggaggaagaggggttagtcttactgtctcagggttggcagaggcaggagaaaatctacatataagtagactcatgcagtttaaaaccatattgttcaagggtcaactgtgtatttatttgatgcttcagaaaggggaccatgtcaattcctgataaggttctctcctctttccttttcctccatctctctgtgtcgatcctagtgctctcatcggcttttaaccagtagaggtctccaaactgtcttgtggcagcctgggctccctatacacagaaagacctggcttcaaaattctggttaatatgggaagtgcattaggaagtagaaaggaaagaaaagtcaaacaataaggaaaggattaatataaatcataaattaattttgtgggcctaattactattttttaaaacactgtaagttttagtagattttcttactctaagttatagaagtcaaaccctaaaacacgttaaaaaaaatctttttgttatttcttaactattacggttattttatcaaaattaattaatatcaaattaatgataatacaaaggaagtcacattattaattaaacaaagtgacttagccttgcaaataaaacactatcgtgtggattaatagtttgaaggtttaactttacagccttttcaattgactgtaatttagagcatttttaggttcacagaaaaatggagcaaaaagtacagagagtttccatatactccctcacccctccccacgttatacatagtttctcttcttattaacatctttctacgtcatgtttttggtgttacatacttgccacacatagtaccctaataatctcttgggccgtacattctctgggtttggacaaatgtgtaatgacacagatccaccattacagtatcatagagagtggttcccctgccctaaaagtcctctgtctccacctgttcatccctccctcccctctgctccttgcccggtccccaggcaactactgatctttttcctgcctctatagctttgccttttccagaatgtcatataattggaatcatacaatatgtacccttttcagattagcttctttcactttgtaaaatacatctaagtttccttcaggtcatggcttgatagatcatttcttttgattgataaataatatttcagccttatttttgtaaggaaaaaatcaaatcaagaaactaaagtttgaacagccactatagaaaaaaaggcaaaagtcaataaacaaaaacaattgttcagcttcgctcataattgtatacacctcccagctcttggactaggtaacatcagtggccagcaagatgccaccgattgagtgattgtttttatttcatgccatgtgacccattggccctccttttcctgacacatttataatcatcttaatcccaaagcaactgtttttaacaaatatgcatatatcctctgattttctgttgctataacagaatacccaagagtgggtaatttataaagaaaatgactttatttcattcatgcttctggaggctgggaagtccaaggtccaggggccacttctggtgaggactttcttgctgtgtcatggcatggtggagggcatcacatggtgagaaggcaagaccaggtcaactcaggtctctcttcctctttctttctttctttttttctttttttttttttgaattggagtttcactcttgttgcccaggctggagtgcaatggcatgatgttggctcactgcaacctccacctcccgggttcaattgattctcctacttcagcctccggagtagctgggattacaggcacgtgccaccacgcccagctaatttttgtatttttactagagatggggtttcaccatgttggccaggatggtctcaatctcttgacttcgtgatcggcccgccttggccccccaaagtgcggggattacaggcgtgagccaccgcgcccaacctttttttttttcttttcttttttttttttaaagacagtctcacactgtcgcccgggctggagtgcaatggcacaatcttggctcactgcaagctccgcctcccagcttcaagtgattctcctgcctcagcctcccaagtagctgggattacaggcgcccaccaccatgcccagctacttttttgtatttttagtagaggcggggtttcactatgttggccaagctggtctcaaactcctgacttcgtgatctgcccgcctcatcctcccaaagtgctgggattaaaggcatgagccaccgcgccccgcctctcttcctctttctttaaagccaccagccccatcatagggacccaccgcgatgaccttatctaattctaattacctcccaaaggccccacctccaaataccatcaacatatgaatttagagattaagtgtccaacacatgaaatttgggggacacattcaaaccatagcatcttctttaagataatgtaaaactattaaattaaataatagagtagaaatcacactaataatttgtgggtctattcagattatatattacctaataatttttacctattttttgaaaattgttccaatcattccccctgcttccttttcaaaagagtcaaacatagccagttaatttaaggtatctgcaaaacctttccaccaagacttttatggtacagagaagtgactcataagccacaattcaattaaatttagcaaatatttcttggacaacaactacatgcttgaggttggcatggggacctgtttttaaacctcctgttcattctactttgactttttaattacaacagattaaaatatcttattcagcaaaaaaaaaaaaaaaaaaaaaaaaagagagaaaaacccactttgtatattgaatttttgaatacacaagagaagtgcaactcagggtggtgggattcctacctagcaggcctgtctccctttgattaccccaatattccaaaggtgcaggttttgtgcaccaggcactctaataggaccctatcagctcagcgctctcagaaatttcagttgtctcccagcccctagaaagtcacaatagctccagggttgtgcttaacgggccatagtgggaggatttggaaaggagaaggtgaatcttttctgtgaaaagcaggtggaggaaactgaagagtggggagaagagaggtggatgctgacctgaattgtgttttcaggagcaggaagagtgtgctctctgcttaagagatgacctgaatggcaagactacatgtcactcggatggtacacagatactgtcttgatgggagttttcggaacagatttgtcctcccagggtgaaatagcagagagatttgaggcagccctcaactagagtatgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctcagcaaacactggtggcatcaaaatagccaatcatgctgatggctgccacacagctcatggaagccttccacaggccagctctcttgctgttggctggctggacttcccagctcagtccctcacctctttacaggacaaggcacaccagaaaccaaggctgttgggggaggcagcaacagagaccagacgttccctctgcacacacatgatgtcatcaatagaaactctgctgatgatgaacccactttcacacaaaccttttaaagcctgagttattttttgcaatgacaaaaataacaaaccacatttttttaaatagcttccttaataataatggaaattcaggtgacattaatgaaaattgtagcacatgttcaaatcagaatctatgttcagtgttatatgcagaatataaagggatttcttttctcaattgatagaaaagggaagtcatatttaagtagtcacggtatcctagatttttaatatagcaacataattgaataatattttgatgtatctggttttagtatttaaggtgataaaatattaaatttaagcttaaaattaaaaatagaggaaaaagaaaaacaaattgaactgaagtgaaaatgtttcttgttttttaaaaaatcattgtacataacagttttcaccttcacttttagaaatcaaagcacaaccctctatcacatggtaaagagagtcagccatacggaaaaccaagctgattgttctattcctgtgcaaattctaaccctaaaatatttctctataatgctttaagaaagaaagtaaatctggaaaacattttttatcattttgaaagctgcctttgttttgattctcattgtgaaggtcaaggataggagaatttccagagatgggaatttatcttcactttatgctatcatttcagaatgaatagtgatcaggttctaaataatgcattccacaggtgtgagcaaccaccctatcactttctatcttcatgtggctggtgcctacaacactaaatttctgcggcagattcattaaggtagttgttcattccctgtcgtaattagacctcccatttcagccttttatgtcaaatccatcactcaccctggcactcaggctcacctctttacaaagcccttccctggtgctattctggctctaaacacaggtgataaatgtgtcagcatggggcacattcctgtccctgaggaccatcaatcgttaagtacagagagctttttccagcagccttctaagatttatacccatgaggatattatttttgtggctgcatgaaggagaattattacttgaaatgggttttgtgaaaggatggttttggtgttgctttggcaccattttaagcttcttttcacaaaattgaccggcgcaagtcagaatttatacttctatgaatgtagatcttcaccatctgatggtgctgagtcctacagagaagaggatttgagactttccagtttttagagatctctacgatgtgcaagaatctagatattcagaggccgtactgacttcaatcacatggtaaattagtatatgagagttcgcagtaataaaagaagtatgtaagtgatcagcatgtgttttagtcagggttctctagagggacagaactaatggaatatatatataatatatatatatataaaatatggaatttattattaagtaataactcacacgatcacaaggtcccacaatagaccatctgcaggctgaagagcaaggagagacagtccgagttccaaaactgaagaacttggagtccaatgttccagggcaggaagcatccagcacaagagaaagatgtaggctgggaggctaggccaagtctccctcttcacatttttctgcctgcttgtattctagccgtgctggcagctgattagatggtgcccacccagattaagggtaggtctgcctttcccagcccactgactcaaatggtaatctcctttggcaacaccctcacagatacacccaggaccaatactttgcatccttcagtccaatcaagttgacagttagtattaaccctcacagcatgggaggtaatgcgtatgttaaatagtttcatttagccatttcacaaggtatacagattccaaaacgtcatgttgtataccacaaatatatgaaatttctacttgtcaatttttgaaaaaaaatgtttaaaagaagtgtgtaaataacttcttactttagatataaaatcttaagggccaggaaaagggcaccaaaatccagcctttgacatctcagaagaagcgatgattaatttcatttcattctgttggtttccatggagtggtgctgggtggtgaggcaaacacagcagcaggaatgttaacatttcatattttagccctaggagtaaagaaaaaaaacatgtcccagatcagcactagctagaaccaggaaaccccaaaagcaaaggtttttttgttttgttttgttttgttctgttttttgtaaaagacaggttttcacaaaggaagttttccaaattctatgtataagagagttgagaaggaagatttttctctcttcttgcccaggaggacaaagggaagagtaccacattaagccattcaggtaaagtgaagcttattgaacgctgtggattaggataaaactaatagagttttcatttttaagccagttcagatattcagattaattatggacgtaatgtagaaaataccaatttctgcaagttctacatttcatgtgaaatcccaaagaggttaaagctgatgggttttaactgatgaaaacacgtgcctctgattaaaaatgtttgtagtgatgaaaacaaagcatgctagagttacagtgtgtagcatgctgaagccaccagcagagcttaggggacaaaaacaactgtttcctaagagaaaaagaggctgagtatcttaagcctggggaagggaaaagacagtagttagcaagctcaggttagccactggtattactctacctttcatgagactcttcactggggaggttggggagattcggtctcacctaaaggagagatggctcgtgaacccaaggatgctgcagggaccctggccaccacttgcagcccaaacactagaatgaggaccagagaacacaatctagctgcttcccatccatcccctccaccccaacatctggtctcagcaacttcctctgccctacactgggatgccctccttagttgatctgaaccatgcagcagatgaaacatgttggcctgacaagtagcagatggctataattgcctgagccatctacaccggcaaatttttcttctttatttgcatatgagtaaaatttttcccagtgttaaattatggtgtgagtagagattttttgagggagcacagcgcagttgtatagacatcgtgattgacaaaaaataaataaaataaaataaaataaatgaccaaaatctgctaaatgaatttgaattaaattgttctaatgctttctttttctttgtaactcttcaccaccacctcaatacatgcattcctggacattcacgcatacactcacacaaacacaagcatggtattttttgtgtgtgagacactgaaggtagcatgaaatagcaaccaaaaaatctgcagtattaaagttagatatgacttggtttgacttgcaaatcaactgcctcactagtaagatgacttctggtatatggatatgtctctcagttttacaggcttgttttcggattaatggtaatagatgtaaagaattgggcacggtaagtcaatagtcaaagctattcaacaaattgaggacaaacaaggaaatgggttaggaattggtctgtagccagtctcagaaatgttgtattaacctttgggatataatcccccaaaattaaagtatagtgattcatccaaaagtacaaagtgttactagcaagatggatgaggatttccatctaacatttttcatcttcttatccctgacacattattaaaacacctagattttggtaaaagaggagaagtcatgtcttggacaggattgaaggttgtgtcaacattccctatgctttcaagtttcagctttagaatccaaaacccccgggcacagtggctcacatctgtaatcccagcactttgggaggtcgaggcaggcacatcacttgaggtcaggagttcaagacaagcctagccaacatggtgaaacctcatttctactaaaaatatggaaattagccagtcatggtggcgcattactataatcgcagctactcgggaggctgaggcaggagaaccgcttgaacccgggaggcagaggctgcaataagccgagattgcattgcaccactgcattccagcctgggcagcagagcgaggctccatctcaaaaaaaaaaaaaaaaaaaaaaaaaaaagaatctaaaccctttggttcacagatggaaggaaaaagcaggcggtgtttcctattctatgtgtatgccatgcctcgagccctgaacaggctactcatctgtggccaatattatattataacctctccattctcagaaggcacgctggcacccatctctgcaagaaaggcatcaaattgtctgtaagtcacagaaatgttattgtattgtcctttattcattcattcagaatatactctctaagcatctatgtaattaaacattactaagcttacatataattaacctcgaaataataactaagcattgttagttttatgtacggctaacttaagaaataaactcactttctagttatcagttttggaaaacaaaagagctctataacaattttgaattaatcaaaaattggagaattctgtgcaaacctataatccttccctctttagggtgaaggagcaacgctttgtgttacttaaagacacactttgccattgtgattaactataataacttttaaaataatcaaaaaatcagtccactttcttgtctatttgtgtattgatcactaaaattattgtacctagtatgatcaactttgtatattactgtatttcattaaagcagctaacttctcttgtccagacataagagaacactagaagacaaaaaacaaaaaacttttatgaatctcttttccttacgaacactaattttataccattttaacatacttgaggtggcaaaaataaacatatatatattatatcatccaaaagtatttgcatattttattaatctattgccattctaagaattcagggtaagttaaaattgtgttaccaaccagcatttattttgcatctgtttcactcttgaaattgtctaggtttcaaagattattaactaattaacttcaccatttgtctaaggtcttaaagttagttaaggatcgagaaatcacaatttttgcaaacataatgaatcctgacacccagcacttaaaaattttacaaaacttaattcttttaaaaatccattaccttttcatttaattgactataattatatgtatgtatgtgtatacattttaaacaagttataaaatttgtgatgatccacttataaaaacaatgtaggaaatttaggaacttaaatgataagaaatttatcattggtctcgtacaaaccaaagtattattctgatattatttttatatgataaatgaaattgtaaagaccctaagtcgtgctcaaggctcttcttctatcttgaactaaggttttcttcttatcttgtaactatagtaacaagggctacaaaagaagcacagcttaatatttttccttttagacatttttgactactaatatggtacagatattcctaatgtgcactcataatgatagagtgaatattttaatcaattttttttttttttgagacggagtctcgctctgtcgcccaggcgggagtgctgtggcgcagtctcggctcactgcaagctccgcctcccgggttcaccccattctcctgcctcagcctcccgagtagctgggactaccggtgcccgccaccgcgcctggctaattttttgtatttttagtagagacagggtttcaccgtgttagccaggatggtctccatctcctgacctcgtgatccatccgcctcggcctcccaaagtgctgggattccagacatgagccaacgcgcccggcctcaattaatttttaaagcttcccaaaagaggataaaagaggaggaaaggaatagaaaaaaaagcagtgatagggacccaccttcagacacttaagacattatcgctgtaaaaagcaagggtcttccctctgcaagaagaggcactaaatgtttagattcaggaaaacccactgtgacatatatacatgcaaaagataactcttacagctggtataaacaattatttgggccttgaaattcttatcaagtaacatgtttaaaagccagactttattaatcctcaaagaacagaaatgtagaaaacagcatttacaatgagccaaaaactctctctttttagattgcaagacaggtatctcttcatgaagctttctccaatttttgttctcaggcaccactcaaatgaacaatcttgttcatgtcaaaaaggtccccaaaatagccactgcagttcaaaattatcctgtgaaattggctaggcatggtagctcacatctgtaatcctagcactgaggtgggcagattgcctgagatcaggagtttgagaccagcctgggcaacacagtgagaccccccccgcccaccatctctactaaaatacaaaaaattatccaggcatagtggcatacgcctgtagtcccagctactcgggaggctgaggcatgagaattgcttgcacccgggggtggagttcgcagtgagccaagatcacgctgctgcacttcagcctgggaaacagagcaagactctgtctcaaaaaaaaaaaaaaaaaaaaaaattatcccgtgaaattctgccagttaaagacacaagcatgtcagttaaggtgatgtgagaaagcaggtatttgtttcatagaaaatgcccagttttaggatggatcagacactatgagcactgcaatagatcctcccacacgatggtgcccgtgcagcctactttcgtcaggacttggccaaagcccattccagggtcagacaatcccttctgatttcaagaagcctaatctaaacaaagcagctctcaggaaaagaacaagaccgacgaaaaagttcttctaagggttcgaaatcatgacccaagtcaaagtttattcaaagaatgttgattgtaggagaacttctgaactcctaggcccctgagccagctcaagaactgacttacctggcttatgctcattgtctccctagagaccttttgttttagagataaagaacactcaagacactgtacaagcagacagtccataggaacatatatctgtagactggtaaacagtatcaccaaagaacaataaaaatcagatcagataaccaaaaagtcactggtaaccttattcctaggggaagaaaaaaaaagagagggagatagagaaaaggaaggaaggaaggaaggaaggaaggaaggaaggaaggaaaaacacctaaagtggaaggacctcagcagaatatggaagctcagttcagcatgaacttctcctagcacgggcagtgtggttacatcagacagctagagacacaaagggtctcaaataagcacactaaaattggtgagtggagggttcccatccaagactgtagggctcacagatgaatattgatggatcttcaaatgcagagattaattacagccactgaccactaggagcccacctgtagtagaacaaatgtgggattcttcactcattgcatcatgggagattgctcattatggagaaccatagaggcatctcagtaagaggatgctggaaagagggtgctagaaagtgctattcggttttcagtaggtgatttggggagagttaaaaaaagtaggggtttgttctagattggatactgtcaggaagcaggtaattctgtgattgaatatcttaatttttttttatcttgaagacagtagagaaaaacagctgtagttggtaaagaagtagaaatgatgtgtattaggctgagaaggggtatgttggatcattttcgtgttctggccagttttcttttttcagtgctgagacatgtctcatggagtgacctcttctttgcctttccccatgaaggtcacggaatgaccttgtctgatgttgagttctgtgaaatggatcaccccaaacagaagcacacatggcctggctgtgagttcccaaacagctccccacgctcaagagctgcttttctttctcattctcaattaaggattgaaggaggacacaaaaacacgatcaccaaaggaaaatgaaacaaatttaaagtaaataaaactcagcaaaaagaaaaactacaggaaaagaaaagtaactgtaggaaacaataatgacttagccctaaatggcatttacgtggtcttaatcatatgtgaccttaatcctataaaaaccaaattgtgatctaactccaagtccaacctgcctattttagaagggtagttggatggtgctagtggatggtggggaggagagtagaagctaactcatcatcatccgtattggtaagtgaatagataatgcctaaaaacatgtcatgaaattgcaatgtcaccacatcatttggagatacgtttttaagtcagcctaaagggttgaaaatgcttctaggctggggcaacgggagggcagagcatagaagatggtaatgattcctgaccatccttcaagaactatctttctaattttttccatcttctcctccctgctttattctagccacactggcagctgattagatggtgcccacccagattgagggtgggtctgcctctcccagcccactgactcaaatgctaatttcctttggcaacaccctcacagacacacccaggaacaatactttacatccaaccaagttccaaggattggaacaatacaatcaagttgacactgaatattaaccatcacacacagacatatatacatatatatatattttttagacagggtctcactctgtcacccaggctggagtcgagtggtacaatcatggcttactgcagcctgaagcctcaacctcctcagctcaggtgatcctcccacctcagcctcccaagtaactgggactacaggcacacaccactacaccttgctaatttttgtattttttgtaaagatggggtctcactaagttgtctatggctggtctcgaactcctgggctcaagtgatccacccactgtggtctcctaaagtaagtcatggcacctggccaactttttttttttttctttttttttgagatggagtcttgctctgtcgcctaggctggagtgcagtggcacgatctcagctcaccacaatctctgcctcccaggttcacgcctttctcccacctcagcctcctgagtagctgggactacaggcgcccacgaccacgcctggctaatgttttgtatttttagtagagacagggcttcaccgtgttagccagaatggtctcaatctcccgaccttgtgatgtgccctcctcagcctcccaaaatgctggtattacagatgtgagccaccacacccggccccaactttttaaaaatattttttaaagaatgagtagaagtagccaggtgaagaaaagaaaaggaaacagagctgggaaaaggtgtgttgcatcagaaactagaggagggcatttcgcctggaccagagaaagttctgatgagccaggaaggctgggcagagccagctcaggccaggcaggcgcgattctgcacaggacaggatgcacctccaatgaccacgtgtttctaggttgtttccaagggcacacagataacagtcaacgatttttttctgactagccactgtagtgatcgctgctgtgtgaccctccacactttgcttccctcgggcctcagctccgcctcattccactggcctaataattaactcagccttattttcccaacctaattgtttcacagaccaaaagaaatattggatgtaaggtacaatttgaaaagtgtaatgtgctctagaaatgcataaaatgatgattagtctttgcccagtaggctttttagcttaataagctcctgataatacagaaatcactgtgagcaactggcagagaaagatttttccatttctcttaactaagaaaagagatttaaagtcactttggagagctaacactaaataataataactgccaaaggaattgatttgatgctgaatataggcttgtgtaaggaggtaaaaaactgtccactaaagttaatgctcatagtaagaggcctctgtccttgaattcaccttgagagagttgaacagggataacggattttcaaggacacacatctacagagaaagggcgtatggaaatggaaaagggaaagctgctcctagtgtttttgctgaattgttctctttctctaacccagcaggagagatgctaaaggagattttgtcaaagaaaatccttgacattggattcttaaaagccttatggtttcatgataggccctttaccaaggattcttaagggacaaccttatgttagagagaaacaaagtcctgaatcatatttcctcctctctggaatatatgtagaaatacaagtgagaagataaatacatgtgtaaaaagaaaattcatactttcatactcgttatatgttatgattaaatgttgattgcatttggagagcatcagcatatgaactatattacagaaaggatagtcttttgtttcatggcttaaatcttcttttctcaataagattaaggggctagctaagattataatcataacaattttttttttttcactgagtttccaccctgtgaggaacactaggctaagcaggaaaaaaaaaaaaaaaagtcactaaaagaccctaggctatttgtacaccaatgttcatagcagcattattcacaatagcaaaaaggtggaaagaaccaagtgtccatagatggacagataaacaaaatgtggtctatacgtacaacatgggtgaaccttaacattgtgttaagggaaataagccagttacaaaaggacaaatactgtatgattccatttctatgagatacttagaggagttgaaatcatagacacagaaagtcagatggtgactgccaggggctgggaggagggacaatggggagttgttgtttaatgggtatagagtttcaattttgcaagacaaagaatttccagagatgggtggtggtgatggtgcacaacaatgtgaatacacttaatgccactgacttgtacatttaaaagtaggttaaaatgggccaggcatggtggctcacacctgtaatcccagcactttgggaggccgaggtgggtggatcacgaggtcaggagtttgagaccagcctgactaacatggtgaaaccgcgtctgtactaaaaatacaaaaattggctgggcatggtggcatgcgcctgtaatcccagctactcaggaggctgaggcaggagaatcactggaacccgggatgcggaggttgtagttagccaagatcatgccacttcacttcagcctgggtgacaaggcgagactccgtctaaaaaaaaaaaaaaatatatatatatatataggttaaaatgtccattttatgttaggtacattttactgcataaaaaaaaaaaagactatgggcaagccatttccttcctctgtgcctcagtgacattatctgtgaaataaatgtgtagaaacagatggactccaaggatgcattcaactctgcaagtctgtgtgtctaaacatcccctctgtcctcatggggtttagcagcaagttggagagatgaaatgcagtaataaaatgtaaaatacttctagttaatgttttaagtacccaattagtgattttttaaaaaggaatatgtattcccttgagaagggatagagcagaaatctggaggacagctttgtggagatagaactggaccatgcccacttcaagaagtatgtagctcggatgtggatctgtgccagtgggatggccttaacaaaggtgagcaggcttcaccacaccagggggtccgtagaacagcaagaagatgagcctgttggtggtagaaggcttctgcgtcaaagtgaagcattgaggaggacccatgggtgactttgagggactctgaatggaagagagtggatggacgagacacctggcctatccacaaactggccctatagccttgaataatcactgggacctcagttcctgctgtatgacaccaaggctagctcctttacaagacggaagcacagcctagctgatcttgctcttcctgctggaaaactccatgattctctttgccttccaggcaacagacacataagattcctgctgccaggtcactgctggatgctggactccagcagtgacaggccccgaacctgcccttgtgaaggccactttcttagtggtggtggctcatctagcaggctgaggaatgtacaaaggatgtgtaagaaaatctacctagcagtagggtatataatgagttaaagaactgagcttctactggcaatgagaccagccagggtaatgttgcaaaagtttagatgtacattaagacccagaagggctgaacttggttaggggagaggaacatgaaatgaaaagtctaatgcatgaaccctagaaccacatgaatattaaagctcacactgaagtatctgtgcctccttctcccttgccctgccctttttcagcctcccaaagctgcacccattcctcctgtgtccccaatatcccctatgccatgtgatgtggtttgactctgtgtccccacccaaatctcatctcgaactgtaatccccatgtgtcaaggggggacctggtgggagatggttggatcatgagggtggtttgccccgcgctgttctcaggatagtgagtgagttctcacaagatctgatggttttataaggggctcttctcccttagctttcgcttctctcgcctgcctacttccccttccccatgattgtaagtttcatgagacctccccagccatgtggaactgtgaatcaattaaacctctttcctttataaattactcagtctcgattattctttttttttttttttttttttttgagattgagtctctctctgtcacccaggctggagtgcagtggcaggatctcggctcactgcaacctctgcctcccaggttcaagcaattctcctgcctcagcttcctgagtagcttggattacaggcgcctactactgtgtctggctaatttttgtatttttagtagaggcagagtttcacatgttggccatagttgatcctgatctctcaggagatctgcccaccttggcctcccaaagcacttggattacaggcatgagccttgggtatttctttatagcagtgtgaaaatggactaatacaccatggtaactgggtcccatacatcctgaaaatactaatagaacaaatattcccactcctgaaatttaacttgatcctgaagacgaaggatttccttgagctcataaatggaagtggttcatcttccaggtagagaatgcaaggtagattggttttgttcacaggggtcatgcagagctaagcacatagaaggtgctcagtaagcacctgctgaacatactgaagtgacatagccaggcagagacgggtaggtggacagccaacacgccatgagagctggaagggcgcatcctctcttaggagcttgggccctggccagctgactcagcttcaagctctgctagtacataagtccctcggggcctataagcttggccgtgttgcagctgaaatttctgctgaataaggtcatacatactaagctgagaatgcaatagtgagaatggctccttctttttcgcatcccagaccccagaatagaaatatttaccatcacgtctggatgataatatcaataaattatcagacattgcacgtattaagaaaagctcattttctggaaattgtccttattgtcctaattgggaattatcttgaagccgtggatagaaaatgacctttcagattgctgggacaaagcccaagtctaaattggaaacgtgtttaatggctaagacagcccacttccagattaattatggatgcttttccatttcaagattacattaggaaggaaagttgtcactgggtggaatgtgagtctccactgcatccttttaagataaataagttgaagtttgaagaaaatttgagattacttttggttaagtgaataaaatctgtttagcgaactctttgaagttgtggattgcctgggaatctacaaatctgcaacctccctccctctagatacattcagagggtagaagagaagtcatttaaaaccttatgcttgacttcttgcttcctgccttggtttttaaccaaaactaaaaataaaaaagccaaaagagaggaaacttgataggttcaaaacaggaaattagattgtaagcaaagaaattgtccaaacatcgaaaaaaggaacacatcaaagaagggaggtgctttgtttttatactttgttatcgtcctggaaaaaaatgtctgctgcctctgataatacatattaacacttcttttttacttagcttttatttttatcaaagtaataaaatcatcttgtttaaagtgtcaaatagttctatatggcttattaggataaacaaccatccaattttcaagatttttttttcctttggcatttgtctttaattctctaaatatattcacctgctacttgaggggtcagcagacttttcctgtaaagagcaaaacaatgagtattttaggctttgagagccatagagtctctgttgcagttactcacctctgctgttgtagcacaaaagcagctgtgggcaatatgtaaatgagtgggtgtagctgggtgctgaaaaaactttatctacaaacacaggtggctgcacagtgggctgtcctttaccgtctcctaggctactccttgagtttctgtttttagtcagtcactgttaggtgactcctgactatggaagatgaggattaggctctttcacagccaacaactctcctccatggcctcctcccctccatgtttttcctttaccttcacccttccaataggatggtttactggctttggatagatccgtatgcagtgtttacatcatcatgcttttcataactgaaccatataatagagctgtgtttccagccaggcatggtggttcattcctataatcccagtgctttgggaggcacaggtgagggattgcttgaggccaggagttcaagatcaacctgggcaacatagtgtgagatcctgtctctacaaaaaaaaaaaaaaaagacattaacttggtattatggtgcacacctgtagtcccagctacttgggaggctgaagtgggaggatcacttgagcccaggaattggagactgcagcgagctatgatagcaacactgcactccagcctgggtgaaagaccaaggccctgtctcaaaaaaaaaaaaaaaaaaaaaaaaaaaaaagtttcctttcctacacactattttgttttccttaatcattatattgttttcttcatttgcttaattttttgtgaactaattatgaattgaaactcaagctctctctcaattttaaaatcttccctcaacatattgcagccaatataagaggaactcaccatttcattttcttggaaacttctaccccagagcattctggctggataggccttgggcatctgtattagtctgtcttccttctgctataaagaactacatgagactgggtaatttatgaagaaaagaggtttaattgactcgcagttctgcagggttaacaggaagtctggctaagacgcctcaggaaacttataatcacagcagaaggtgaaggggaagtaagcatgtcttacctctgcaaagcaggagaaagcgagtgagctgggatctgccacatacttttaaaccatcagatctcttgagaacccactcacactatcatgagaacagcaagggagaaatccgcccccatgatccaatcatctcccaccaggaccctcccctgacacatgggattacaattcaaggtgagatttgcgggggggacacagagccaagccgtatcaccatccttgcatctctcttctccatcatcatagataacctgggcctccggatggcatgagatccccctcctacccggcttccatgactttctctttgttgatctagtcccttttttaaaaatggagccatccttctgtagcttcctgagaaagaatgaacgggaatcacattttctgaaacattgcaagtctgaaaatgtctttattctccctcatgcttaattgaaatcagactgaatacagaattctcatttagaaattatttcccttcacaagtttgaaggaatttgtctattgtcaatagtattgctctcaagaaattcaatgccattttcattctcaattctttatttgaactcggtgtttttctctctggaagattttaggttcttattcttctttgttttctgaaatctcatgaatattatttgatgtgggtctattttgactctttctgttggaacacacatggggccttttaatctggaaagccgttcttgaactctaggaatagattttgggggacaatttcttctttcatttcctgttctctcttcccagaatttgttattcagctatcagaccccatggactgatctgttattttcttatattttctttcatttgttcaatttctttggctgttgtttcccctattctctgaacaatgttctcaaatttacatttcataaactctcattgagtttttcacttctttttttatgttctgaatttccaagagctctattttttgttctttgaatgttcctttttttaaatcatctgttctcatttcatgaaagcaatatgttatctctcagaaggtattaatgacggttttctcccaagtgtttcttttcctactcagcctctttttccttcaagtagctttctttggttggttggttggtgtgtgtgtgtgtgtgtgtatatgtgtattttcgtttgtttttcttttttcttctcctgtgtttgagacatgtcctcaaatgcctggttcccctttagctgacacccacatttaagattgaggcactacaaatatgactgaaagttctgtgcacacaaatggggcctgtcacccgtgggcttcagtggctgagttgtttcatcgggaagcccctgatgttgcatcactgagatttttgtcttgggctgattgaaagctccagagaagaattttctgccctgttgcctggagggtagacacctggctgtcactgttctcacagctaagaaggaagaggactgcgaggttcaagattcagtgtgtaaatgttgactgaagatccctgttttcagtacagagcccctgccgtcctatgcctagagtcctccaactgagagtctctgtgtccttcccagagaatacatcgttcctcttctgccagagtgaggggaggacagatgcctggggtagggatctggggatataaatgttcttcacgagcttccagtgagttcttctgtttttagcttcacataaacacacatatccagtggaaactcttgccatcaactgcacaaataatgggcggctttgcagtgccaaccgggctacttctcagcactctccacctcagtgcaagcatctgtccttggatatgctgccacttaagatggttctgctgtttttcagctctaaaaaggttgttatcatcccctgcctcatgatttgttcttacaccttcgtatatcttaacacttcattccccttttcacgggctttatgaagaagcagtggtaaatgtaggtgctcaatccaccatctttaatgggaatccttcagcacttctattttagaaaaaatgtgaagaatatacatagagactgggcatggtagcgcatgccggtaatcccagcaatttgggaggcggaggtgggcagatcacctgagttccggagtttgagatcagcctgggcaacatgacaaaacccacccatctctacaaaaaaaacacaaaaattgcccaggcatcgtggcacacacctgtagtcccagctaatggggatgctgaggcaggagaattgcttgagcctgggagatggaggttgcagtgagctgagatcacaccactgcactctaacctgtttgacagagtgagaccctgtctcaaaaaaaagaatatactaaacactcatttcacaatattcttgacttattaaagctggagtcatggcataatttccaatttgcttttcaaaagaattaattgatcagctaagaaatttacaagtaatttttttcaaatagtgaggtcccttagtattaaaatgaatttcatgttttaatactaggtttttcctcccacgcagtgaattttcttcttgctttaagaagaaatgctctggagagaatataaaattatatatagttgtgtatgaattatatgtcataggattacatataattatatgtaaatataattacaattataacattaatacatgttcactgcagaaaacttggaaaaaaacaaagagtttaagagaaacttcataatcaactgtattctcaacaactacagaaagcttaaccaatgatttgtccgtatccatggctaagaacgaatgtacctacacatctgtgccatttttaaattggcattttttaaaaagtagatccaattttagaagtttgaaatctagtttaaaagcctagattttatttttttccattttaacctatttatgtatttatttatttatttatttatttatttatttatttattatactttaagttctggggtacatgtacggaacgtgcagttttgttacataggtatacacgtgccatggtggtttgctgtacccatcaacctgtcatctacattaggtatttctcctaatgctatccctcccctagccctcccaccccccaataggccccggtgtgtgatgtccccctccctatgtccatgtgttctcattgttcagctcccacctgtgagtgagaacatgcagtgtttggttttctgttcttgggttagtttgctgagaatgatggtttccagcttcatccaagtccctgcaaaggacgtgaactcatccttttttatggctgcatagtgttccatggtgtatatgtgccacattttctttatccattctatcattgatgggcatttgggttggttccaactctttgctattgtgaatagtgccgcaataaacatacatgtgcatgtgtctttatagtagaatgacttataatcctttgggtatatagccagtaatgggattgctgggtcaaatggtatttctggttctagattcttgaggaatctccacaaagcctagattttctagaggaattcttctctatacagggaaacattgcagtaatgagtttaagtgcattgattctttaagcacatttgtttgttgaatgataagactattgtatgtagttcacatccagccccctacacaactgtcacacacaatgaccttcacagtgattcatgcctgaacaacattgtttcctttgcctttaggcttgcaattgggaactcattttatttgaaccaaagccttcagtcgagatgaaaattttcactcacgtctgtgtgaagagaccaccaaacaggctttgtgtgagcaacaaggctgtttatttcacctgggtgcaggcgggctgagtccaaaaagagagtcagcaaagggagatggggtggggccattttataagattcgggtaagtaaaggaaaattacagtcaaaggggggttattcgctggtggcaggagtgggggtcacagggtgctcagtaggggagcttttgagccaggatgagccaggagaaggaatttcacacgataatgtcatcagttaaggcatgaacaggccattttcacttcttttgtggtggaatgtcatgagttaaggcaggaaccggccatctggatgtatacgtgcaggtcacaggggatatgatggcttagccttgggctcagaggcctgacattcctgtcttcttatattagtaagaaaaataaaatgaaatagtggtaaagtgttgggacggcaaaaattttggggggtggtatggagagataatgggcgatgtttcttagggctgcttcgagcgggattaggggcggcatgggaacctagagtgggagagattaagctgaaggaagattttgtggtaaggggtgatattgtggggttgttagaagaaacatttgtagtgtagaattattggtgatggcctggatacgattttgtataaattgaaaaactatacggaataagagaaggagaaaaacaggtattaaaagactaagaattgggaggacctaggacatctaactagagagtgtccaagggggttcagcataattacttacttggttggcaagtttttgggctctatccttgagttttttatgttgtcatacaccaggccagattgatttaggtaaaaacaacactcttcatttaagaatatacagagtcctcctttttcagcagtgagtaagtcaaggcctcagcggttttggaggacaactgcagctaaagagtcaacttgggcctggaggactgataaagtttgtgatatgtctgtgatgctagcagagaagtcattagagaggctacggaaggtcgtgacagaggttgaaatgcctgctattccagtaccgagagcaatagtagaggcagaaagtcctaaaccgacaagcaagggaattagtggaataactcttttttgtcgtgtcggtgtcatgaggggaacagggagctcttcggtcctatttgcaaattgaattttgggggtaaggaagactagtgtgcatgtgcctgtccaattagcaggtagacacatgtaggtagaggatccacagacgaagagaccttgtgcgaggcaaaactggagatgcaaagtaaagagaagcagtgctgaaaggggtgtcttgtacccagactcctaggtatccagctagggtggcagccgtcagaggttgtaatggggattgatgaagtaactgcgtagagggggaggttcgatttacatggtgtgtgagaaaacgttgagtatctacgagcaacctttcactgttattttcggggctgggtataagtaaacaagaagagggctttggagatgaagagtaaaggaacatcgagaaggtgaaagattacctaagggaattccagtaggtctttgctgagagatacataaaggagcggccacaggaatagtagtttgtgttgtgagaggtctaaatatggggggagtagagttgatataaggagaaaggtttttcaagtaagtgtggaggagggtggcagcttgctgatgtgaaatgtctggggaggtcttgctggacctgtctagaaagtaaatgagttcttcaggagggtaaaagtgagggctgttaaaggaagtctggaggtgtagggagacaggaggtgttgcctagtctgcatgtaaggtggggacaactgtgtaggccctggaagaaagggaaatgcaaagccagtggttgtttgctaaggagggattagaaacggctaggagagaatgagtaaggttgatagcgtggtggagatagctggggagaggtagagggtggcagaggaatgggaatgagaataaaagtgagtataaaagtaaagaatagaacttcgtcagggtgaaagtactggagggtcccctgccagcaaagatcatctatccactctaagagggagttaagagttgccagtcctgggcgggggcaaatcctcgagcttgatgtgtagggaagggagggggcctgaataatccctgaagagtagcagaatagcagatggaagaagttacttccttgaggatagatttccacgatggaaagaaaatgagaggttctaagaggcaggctagtggcttgtactatagcatagcctgcctttgctggtgtgtggcgattaggcctggtggaactgccatcaataaaccaagtgtgttcagggtgaggaacaggaaagaaggaaatacggggaaatggggtgaatgtcaagtggatcagagagatacagtcataggggtcaggtgtggtatctggaatactgtgtgaggccggattgaagtctgggccaggaacaatggtaattgtgggagattcaacaaagagtgagtacacctgaaggagccggggagcagaaagtatatgcatcaggtgggagaaagaaaatagatcttggaagttatgagaactgtagacagtgagtttaacacagtttgtgattttttgggcctctaaaagtattaaagcagtggcagcagctgcatgcagacatgagggctaggctaaaacagtaaggtcatagttgtttggacagaaaggctacagggtgctgtcccggctcttgtgtaagaattctgaccgcactaaccatgcctaggaaggaaaggaattgttgttttgtagaagggattggggtttgggagattagccagacacgatcagcagggaaagcacgtgtgtttttatgataattatgctgagacaggtaacagatgaggaagaaatttgggcttgactgaagtaatgggagctgtctgtgaagccttgcggcagtacagcccaggtaatttgctgagcctgatgggtgtgagggtcagtccaagtgaaagcaaagagaggctgggatgaagggtgcaaaggaatagtaaagaaagcatgtttgagatccagaacagaataatgggttgtggagggaagtattgaggataggagagtatatgggtttggcaccacagggtggataggcaaaacaatttggttgataaggcgcagatcctgaactaacctgtaagccttgtctggttttaggacaggtaaaatgggggaattgtaaggggagtttataggctttaaaaggccatgctgtaacaggcaagtgataacagactttaatccttttaaagcatgctgtgggatgggatattggcattgagggggtaagggtgattaggttttaatgggatggtaaggggtgcatgatcggtcgctaaggagggagtagtggtgtcctatacttgtgggttaaggtggggagatacaagtgggggggatgtgaaggaggcgttgaactgggggaaaaggtggcaatgaggtgtggctgtagcccaggaatagtcagggaagcagataatttagttaaagtgtctcggcctaataagggaactgggcaggttggggataactaaaaaggagtgcttaaaagagtattgtctaagttggcaccagagttggggagttttaagaggtttagaagcctggccatcaatacccacaacagttacggaggcaagggaaacaggcccttgaaaagaaggtaatgtggagtgggtagcctccatattgattaagaaggggacagacttgctctccactgtgagaattaccagaagatcggcatccgtgatagtctagggggcttccgaggtgatcgggcagcgtccgtcttcagccactaagccaagaagatctgggaaggagtcagagagccttaggccagagttccaggggctctgggagtggctgccaggtgagttgaacagtccgattttcagtggggtcccgcacagatgggacatggcttaggaggaatcctgggctgcgggcattccttggcccagtggccagatttccagcacttgtagcaagctcccgggggagaaggttctggaggaatccctggcagctgcagttcaggcgtttggagttcttgtgtgctggagatatggctggggtttgtctcacagtggaggcaaggaattgcaactcagaaatacattgctacttggctgcctctactctattattgtacaccttgaaggcaaggttaattaagtcctgttgtggggtctgagcaccggaatttaatttttggagtttatttaatgtcgggagcagattgggtaataaaatgtatattgagaataagacggccttttgaccttttagggtctagggctataaagcgtctcagggttgctgccaaacaagccatgaactggactgggtttttatatttgatgaaaaagagcctaaatgctatctgatttgggataaggaaaaggagcattaaccttgactatgcctttagctccagccacctttttaagaggaaattgctgggcaggttggggagagcttgtcactgaacgaaactgtaagccggactgggtgtgaggaggggagatgataaaaggattgtagggtggaggagtggaggctgaggaagaattggaacctagctcgacctggcaaggaggggagaggtcagatgggtctgtagaaaaggaagattagaaagactcagcgacacttggggttgggactaaggggacaggtgggagggaaagaaggaagatttgggacaagttgcattgggaacagagactagggagggaccgatgtgtaaaagagtgcctggatgtcaggcacctcagaccatttgcctattttatgacaagaattatttagatcttgtaggatggaaaaattgaaagtgccattttctggctatttggaaccactgtcaagtttgtactggggtcaagcggcattgcagaagaaaataaggcatttaggttttaggtcaggtgtgagttgaagaggttttaggtttttaagaacacaggctaagggagaagaagggggaatggagggtggaagcttgcccatagtgaaggaggcaagcccagagaaaagagcaagtagagacatggagagaaggggtcggggggttcttgccccctagaaaagcggtacttgccgctgagggtgaaggagaaggagttggggggttcttgccccccagaaaagcagagaaggggtagagacatggagagaaggggttagggggttcttgccctccagaaaagcggtacttgccactaagggtgaaggaccaaggcaggcgtccccgtgtggtcagatgcctctgaaatgtgggtgaataatcaggcaggcgtccccatgtgattaaacaccaagggaagactgtcttccccagtccgtgaccggtgccggagttttgggtccacagataaaacgtgtctccttcgtctctaccagaaaaggaaaggaactgaaattaagagaagggagagattgaagtgtggcaccaagattgaaaggagaaagaggttgagggatagtgagagaggttggagaagagagtaaaaagaggccgcttactggatttaaaattggtgagatgttccttgggctggttggtctgaggaccagaggtcgtaggtggatctttctcacagaccaaagagcaggaggacaggggattgatctcctaaggaagatcccctgattcgagtcacagcaccaaatttcacttgcgtccatgtgaagagaccaccaaacaggctttgtgtgagcaacaaggctgtttatttcacctgggtgcaggcaggctgagtccaaaaagagagtcagcaaagggagataggggtgaggccgttttataagatttgggtaggtaaaggaaaattacagtcaaaggggggttgttctctggcgggcaggagtgggggtcacagggtgctcagtaggggagcttttgagccaggatgagccaggagaaggaatttcacaagataatgtcatcagttaaggcaggaacaggccattttcacttcttttgtagtggaatgtcatgagttaaggcaggaaccggccatctggatgtgtacatgcaggtcacaggaaatgatggcttagcttgggctcagaggcctgacaaaaatgttgttaattgctctggttatagacagaatagtagcaggaataaataatcagaaacatttatggattatatctttgttgatattttaaacctatcagttacctttctagcctaatgagaatgccttgataaagccacattcttggaaattttggttttcataaatgtgcttgggttttataagtcctgctttgcctaccacttgaccaaattccctacagacttttttatataaacacctatggttaagacaaaatgtgttctttcaacaatgtacagcttctgagagtaatgtctaggctggagtatattcatatatattatttatgctttcatttaacaaacacatgctgagatcctactttttgccggacttagtactgattgctctctcctgagcatccttcttaagtcaaagagaatattcattgttagggaaggaaaaaaagatagagggaaaaaaaatagatggcaagaacatggcaggaacccagtcctgaacacccaggggttttcagaataagggagaggttaacaatctacatagagcaactgggattaaaaatgggaagctggcttcatggggggaggaatagcattaggagatatacctaatgtaaatgacaagttaatgggtgcagcacaccaacatagcacatgtatacatatgtaacaaacctgcacgttgtgcacatgtaccttagaacttaaagtataataaaaatatattaaaaaaaaaagaaatgggaagctggctgccaagactgcaggaagactgtgtcagattcagagcatgaccatcagcaaggtaaatccctactgcccacagtcataattggcaccagactctaggaaggaattatatatttacgtggtgcctaatggggatgtgaggatctcagagggagaaaactaggtaggcacaaataatacccgcacaggccttatttacacctattttatgcaaagttctaatagaaatcattaactggtttcctagcccttgcaagatccaacacaaattagtagaatgttctagaaggaatagaagtaaaaatatcaatcacagtaagaacaggcagctagatgcatattggcaagagggcagataaatagaaagatgtgagaagtcaaaaatcctattgcgatctcattttgcagggaaccaaagatcccaaatagctctctctggaggcaccagtgtatatattattaaagactcagcgagaaaagacaattcactttaagacagcaaataaacaaataaacaatgtggagctgccattcccaatccatttatctggaatagttcagcctcatttggcaatctgtattttttctgaagccccacggggtcattaaaaactccataggtcccaaatgtatttgcataatgatagatgccatccccctgcctgacagtaaagaagcagcaatttaaaaagtatgatgccagccaggcacagtggctctcgcctgtaatcccagcactttgggaggccgaggtgggcagatcacctgaggtcaggagtttgagaccatcctgaccaacatggtgaaactctgtctctacaaaaaatacagaattagccaggcgtggtggcacatgccagtaatcccagctactcgggagactgaggcaggagaattacttgaacccaggaggcagagtttgcaatgggctgagatcatgccattgcacttcagcctgggcaacaagaatgaaactccatctcaaaaaaaaaaaattcatggtattattcttttgaggaagcatactagaaatcaagaatcaggccaagtgctgaggctcatgcctgtaatcctaatgctttggaaggctgagatgggagggctacttgaggccaggagttcaagatcagcctgggcaggacagcaagactccagtctccaaaaaaatatttttaattaaaaaaggaccagtcttattaaagtaaactgcagtcctgttactgatcttagtatcaaagcaatgttagagcccacgtgggattcacacctcctagagttcacagcacaagtttgctgtaacagtagataaggtcttggttgccctgagctcatttcttttttttttttagacggagtcttgctctttcgcccaggctgaagtgcagtggtgcgatctcggctcactgcaagctccgcctcccgggttcatgccattgtcctgcctcagcctcctgagtagctggaactacaggcaccacgcccggctaattttttgtatttttagtagagacggggattcaccatggtctcaatctcctgacctcgtgatccgcctaactcggcctcccaaagtgctgggattacaggcgtgagcctccgtgcccggccctgccctgagctcatttctaaatccatcttcctccaaggtggtggcaagcatgcttctttatcccggagagatggccctttcatcaaagtctcattcagacccttctccttttggaatgcttttcttgggaggttggctgggatgcctactactcttgaggatctgcctctgatagagcctagatcttagaatcaggagagtttcttgcaggcccatcagttactgtgaaagatacctgagctagttggctcacaatccacatccatcaaaccgccccctgcagagaagtcacccggctgtcgcctgcttggcttgccctgcctctcgccattctcatttcattagcaatgcgaatgttcacacccttcaatgtgcatatgatgggtgttaatgagcataacacatctgtgaagcgtgtgtgatttttttgcctaataaataggcagtaaacaagaggaagggaagagctactatctgggggcatctgagaaaacaaaaagcaagcaaggtatgagtcagattgattgttcagtgaatcccaaagggccaaaaacttcctaaactggttttggtgtttctcactaggtgtttggacagcttggaacctggatagtcccacctacccaaaagcattcaaattaggcatgcttttaacaaagcaggtggcatggcatgtaaattgtaggaacactgttaacctttgcaaatgagtttcgtggtccgaatggataattacatatttccctccattaggagctacaaactcatcaagattctacaaccaaccggctcttgagtttcaatctccatgtgacaaggggatttattatgagagggcagagagaaaagaggaacaccgctctctttctctgcaatggaatgatggtcagaaaagaacagatcaaaggaataaacctgctctcctattaactcagcttaccaattctggcctacattttcaaagttatcagtaatcaaaacattgggaaaggaattacaacctcttctcctgaaagtttaacaacttccccatgaagcactgcttttgattgcattacaagctattcctgaagaatttatgacctaagatactctttgtcaatgtaggccatttgtccatgagtggagtgactgataaatcagctattaacatagataagaaagcatatcgattgagtcaactttgtgtttaataatatgctagacagtaatgatgcctggaaaatacactctgtaattaagtacttttccctttatatttcatgaagactcttgtatattttattctggcaaaatagattgtgactaacatctcatagaaaagatcatcatattgtgatcctatatctttatcataaaagtgaatttgagggaaatttttataatttttcaatataaaaattattaagatatcaaaactctttgttttttcactactccaaggtttatttcatcatcttaaaaaccttgtgaatacaatcagtctgctaggtcaggggtcaccaacctagggccatggacacctaccgtggcctgttaggaaccaggccacacagcaggaggtgaatggcagacacgcaattgaagcttcatatgtgtttacaactgctccccatggctcgcattaccacctgagctccaccttctgtcagctcggcagcaacactagattctcataggagcacaaacccgattgtgtactgtgcatgcgagggatctaggttgcacactccttatgagaatctaatgcttgatgatctgtcagtatctcccatcacccctgagatgggaccatctagttgcaggataacaagctcagggctccccttgattctgcattatagtaagttgtatagttatttcattatatattacaatgtaataataataatagaaataaagtgcataataaatgcaatgtgcttgaatcatcccaaaaccatcccctactcccctagtccacggaaaagctgtcttctgcaagactggtccctggtgccaaaaagattgcagaccactctgctaggtagaactgcattcttgtgattatgtattttaatgagcgcatttccttttcatatggagaagggaaccacattgccttaattccccaacttctgccccaaagctttctaggccaatatggctgcattcgagttgctgatggctgtgctaccctcccagggctgatgtacagtttcctgcctgggccgtgtcaccaatcactagggtttaggaggctatagtcagatcttgcagaatatgtcagtctcattctctgtagaattttttgtttgcctgtttttttcttctctttggcactggactatgggcagtggcagttagtggtagatccagggtggagagctgagacctaacaaagaatttttttttctttttttttttttttttttttttttgagatggggtctccataggtcacccaggttggagtgcagtggctcaatctccactcatggcaccctccgcctcctgggttcaagtgattctcatgcctcagccacccaagtagctgggattacaagcatgcaccaccatacccggctaatttttgtatttttagtagagatggggtttcatcatgttggccaggctggtctcaaactcctgacctcaggtgatccgcccgcctccgccttccaaagtgctgggattacaggcgtgagccaccacacccagccaacaaagaatttttaggttcccactattccaccccacctgtgctagaccctgtggtgacaacaaaggtgaaacagacatgctgactgtcattaaaacactgacaatctaaactaagaaagatgaaaaaaattaattgaatacccagtggaaagtaagaaggaatagttttaacctccttaaaatgcttttgattgcattataaactattcctgaagacttaatgatccaagatactacttgtcaatgtaggctattcgtcaatgagtggagagactggtaaattggcagttcatgtgatacatacgctttcagagtaaagagaggtttcttctaataatgagaggagcgcctggccagagagacccaggaaacatatgcaaatactagaaatagccccaagtagcaagtgtggctatagatggtacacgtgaaggagagtagtggggttagaccgtgaagccacgaagaaccaggttaaggaatttagacttttatttggtaggcagtggagagatgttgaatttttttttcaaacagtggagtacagtgaggaaggcaggagactttgcagaaggaaatcaggaattccaaccaatgtgttgagtgtaggattctaaatccagcacaaaaaaaccttcaaagcagcagggaaagggtttggctctgattcagcctcagtggttatactgttgccatcagggagctgggcttgggggtggacagaggctggtggcagagggagggatggagggacagagctgagtttttccaaagcagaagaagacggttttgcaacctagcacaccatctgggtcagatttatcaaacaagattatttgttgacagaccatggttatttcccatttaaaggaagcaatacatatattgtatccaaaatggctccccaaaagcagcgttgagctgatgcaaaagatcagtccattctcccagcaaaagagcagtctcttgacatcccaggtaggagggattcatgtatttcacaaaatgtgtccaatgcaatcatcaggcaaataatattttaatgttttcttgacatgctgagagtaaacttgcttcgatgcactgtctccttctaggcacattactctggagtaaaagaagagaggaaagagacagaggaaagaaaaaatatgtaatcacatatgaactgcaaaagaattctagctgaggttcttagaactataaattcttctttttttttttttttctgagacggattctcgctctgtcacccaggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccctctgccacgctaggcatttcacactctcgtacactctgagggaaactcgagaaacaagtgtaataagaaatattcccgctagagcatggcagccataagctaccaaatttttgttataaaatagaaatatacttctagatgtaaacatgtatatgcttatatctaacctctctaggataacttttgtaagtggattttaatataactaaaactggatgctaaagaaatagccctctcttaaagttgtacttgggcacgtctaggatcaaaaagttaatagttttgtctgtgatcaaggagttaattttttgctgcaatatgtttacatctaacattcttttgagctatccacaatctggttatatatcagtttatccaaccttatttctcctttcctacttcaaagacctccattcaagccgttctccaagctcttgcctaaataagtagttttgttttgttttgttttgttgttttttggggttttttttttttttcaaattttttcctcacttctaagtttcattcagggactacctttccccacttcccctcatcattctctttttctaaaatctatccatccttcaaagcccaggttgaaatttgtcctcttcctgaaatcgccccaaaaatgtgccaaatcattcagatctctgccatctctgagtcttataaatcaaattcttagtggcattcatttgactaagaataataaatacatcactattgttataatcaccataatacctggtgctgttgttagatgctttacctatgttacctcttatccagacaatcctgtcctatcacccccattttacgtgagaagaaaccgaggttcataaaggttaaataactagtccaagttcacatagctagcaagtgacagtcataatagtggttcagacccagaaccgactggcttaaaaatccatggtccttcttctgtgccatatggcttcccaattatggatttcttttttttttttttttttttttttttttcagattgtgatttaggtttattcttttttttttatacttaaagttttaggatttcttacattactttttaacaaacgtattttgtgcatgattctaagaggtagtacactttttttttttaattgtttgcctcattttcccaccatgcctacttttcactttgctgaacccgtatagagtgtctggttaatgttagagaaattgaattgaattcctgacatttgggcccttttcttgagttcctcttctttgtccatagatgaatcatcccattacatctaactccgttggacagcttgcttcttcctcaattgtatgtgaatagttttcaatccactttactaaaatctaatagtcaccatctgtgtctgctatataaatgtgaactcttgaaaacactaacatttgtgggtcagaaattagaggacagtaaaataaaccactggaactgtgaagagggaggaggcgtgaagaggcactcccctctctgctgtctgtgggtcaacctttccggcctgcctgtttctcaaactgagtgagacttgtctctgaagccccattttttttttttttttttttttgagacggagtttcactcttgcccaggctggagtgcagtggtacaatctcggctcactgcaacctccacctcctgggttcaagtgattctcctgcctcagcctcccgagtagctgggattataggtgcacaccaccacactccactaattttttgtatttttagtaaagacggggttttgccatgttggccaggctggtctcgaactcctgacctcaggtgatccacccacttcggccccccaaagtgctaggattacagacatgagccaccacacctggcctctgaaaccccatttaattttccaaatgaaggtgatgtgtcccaggcatcatacataggcaagaacccacaaagtggcagaggagcaggagcaaaggggcctgggcaccccctggaaagtcatcatacagctttactcaactgtcaccttctcctggccttccttgaccactgtttttaattgcaaatcccactgcatgatgccctatccctcttccctgacttattcttctccataactcacattttcaaagcattctatgcatttcaccaaattgtttgtggcccttctcctcccaccagaatgtaatttcaagagagtagggatctgaggtcgggcgcagcggctcatgcctgtaatctcaacactttaggaggccaaggcggttgggtcatttgaggtcaggagttcgagaccagcctggccaacatggcaaaaccccatctctattaaaaatacaaaaattagctgggcatggtggcgggtgcctgtaatcccagctacccaggaggctgaggcaggagaatcacttgaacctgggatgtggttgcaatgagccaagatcgtgccactgcactccagcttgggtgacagagtaagactccatctcaaaaaaaaaaaaagagtagggatttgggtctgttttgtactatgctagatacccagcacccataacagtgtcagacacataggacatgtattgaatgaatgaactgatttataagcagaatatttaagactgttgagaagccatacccattctaatcaggcagagcagaaggttaaaaatccacaacgcttacttttgagttgtgttgaaaccattgaaaatatctgtgtcaaactgattaattacctcggtttacagaatcagctttttaacatacatagcaaattctatatgctagccaatggcaagccagatctcaagcaaggccattcttgtaaaataaatggacagatttttgtcttttctattgtataagattctaaagccttgaaagcagtaatatagaatctccttaaatacaaatttaagcatcttttcacgtttatggcctcagtgcctgtttataaaagtagttttgtaagaaaaacagtgtaagaaaaacatctaagagtagatgataaagacctatccttgtgtgaccttcagatggaaaagcatagatttaatctgagattccagaacccacctagtttttaacttcatttgtttgtctaacttaagaacgtgagtcacaactaacaaagaccatctggtgctgttcttccctcctaggagaatgtctccagaagtaaataaaggagaatcttgtccatgcaagctactctcagttccaatagaaaaccatttcagcatctaattcagagagttgcacaggagatggccaaaggcactatctgccatatgtctgcgtctccagcccagccatgaccccaaaccaatagatttatttttaggtagtatcatgtaaacatagaactttttaaactagcaagttggggaaacttcatgattagtcaatctgctagcacatagcagaagctggtgggtgccttcccagcagccagctcctctttctcctacctcatagcaccccagttattttcaggcatctaccctcctccacacagccaagaacttcagggaggctatttccttccccaggcccaaggagcacagcgtggaaggggaaagagagaggttcatggacggctctaccatgatgccatgtgtctgctagtaaacttctactgactgactgagcatgccccaggtgaaataccctccagtacctccttctgtttttggacttacctgttgtctttctccaacctggagactctcaacccttactgcaaattactgccacgtggggagcttttaaaaacctgcagacacccaagtgcacccaagagagcctgtttcaatggacctatgcaaacaggtttttttttttcattaagttctctgggtgattgtaatgtacagccaacaatgagaaatgttatactaattccattactttgaccctgtctttgagatgctttgggagagcttggcgctcaggaccatctttggggatcttttccatcatccagagggaagctggatcttagagtctggcctctcggttatgggtcctgatgttttttcattgtgtatggtttccatgatctgtcctctgcaataaaacagacattgctttctatatgtaattctactcatccttttggggtctctcttcgttaccatctgcccttccatcttgccatctcactcctcactcccatgattctggaccaaactaaccagcattcctaatctagtctcttcttgaaaggatttgaaacggggaagcagctcttcaggaaagaaaataaatagagcaaatgggccgggcatggtggctcacgcctgtaatcccagcactttcggaggccaaggcgggcggatcatgaggtcaggagatcgagaccatcttggccaacacggtgaaaccccgtctctactaaaaatacaaaaattagccgggcatggtggtgggcacctgtagtcccagctactcgggaggctgaggcaggagaatggcgtgaatcagggagatggagcttgcagtgagccgagatcgtgccactgctctccagcctgagcgacagagcgagaccccgtctcaaaaaaaaaaaaaaaatagagcaaatggaatgaagaacctctgtagggctgtgttgatttaaggcagatgtgggccacagttttggtgttcacacccaggtaaacaaggcagcttccttctgctcatacacgtgctcccctctggaagagccaggtttgcaacgggctcgcagtggctttctcatcctggcagcatccagtttcttgtggacgttgctgcatcccaaccacctagcagattacacgaaggagtgaaatacctaccactgaaaagaatgaacccacagagaagggtggcctcactgctcccaggggctgctgcagtggcccgtgggcagctagactggcctgcaggggactgaccctggtggacgcctgagtctatgtgccaccatctaccctgtgataagtgtagctccgacatgatgtacctttgcctgttgatttccaaggacaattattttagcatttcaaaattcagctcaagtgctggacgacttctccctgagttttgctgtttgccagcagcctcctcttggcatgctccctttccaacatcctcactgaacttgttactattaccaccatgtacttagagaatgcaactatcaagtgctattgaacacaccttgttttgtaaaaaccctgttgtaaattgcctccttattcctctgttccatggccagtcaaatcacaccctcatgtaaatagtgacaaagacatattacccaacttcaaattccagacacctgagtcacaggtgttgttaccactaccccaaaccacaaagtgggattatgtgtctcctagaaccgtattataatagacactcactgtcttgcaaattgctcctaacttgggtagaatattttgtatttattacttttgaaaatctatgggtttctattgcctggaaactcaaggattacagcagaattagagaatctggtctctggatcacagatccccccactgccctgcaccgcccccacccctttctcatggagacctaatcatctccacactggatccactcacatggatcttctgaccttgatccagagtttacaggtaaaatgtccacctgaggacactggtttctgttttgacaaaggtagttagggccttggaaagttgtgaaggaatggcatatctcccagaaccctgacttccatcagcatcttattccaggagctctgaggaaacctctaaggcacaagtgtggaaataaagaccacccagatgagaacacgcagaggctatttattcagagcttgctgtagcaagagagtcagccatcgtcacttgtgcctggcagagactctgaggcaagcggggagtgggaaagctttcaggtggagagaggggaaggctggggtgtgccggggctggagcttgttggcccgggaaagctggaggagggctgcctgacacaggaggcatcctgtgtgattggtgaggggattatatttggctccctctggttggcctaaagttggcagcagggacaaaattagggaatctggtatcaattgatcatttggggccagcttcctggaatgtctgctgcagattgtgggtcagcgtgctgttgtcgcatatggccaagctgttgtctgtctgtagattccatctcttggtgttcaataggccttggggccatgaacttgtagggagggttttctcaagacctgggttatggaaccagcattgaggttcacagaactcacatccaccctcaaatcagggctgggtcacagacagtttattcaagtgctccaggcacctgtcccagggtcattctccctagaaagacccaaacaagctgggcgcggtggctcacacctgtaatcccagcactgtgggaggccgaggcgggtggatcacaagttcaggagtttgagaccagcctgaccaacatggtgaaatggtgaaaccccatctctactaaaaatacaaaaattagccgggcatggtggcgcacacctgtaatcccagctactcaggaggttgaggcaggagaattgcttgaatctgggaggcggagcttgcagtgagccgagattgtgccactgtactccagcctaagcgacagagcaagactctgtctggaaaaaaaaaaaaaaaaaaaaaaaaggcccaaaccatcccagggaattcagttcaagccacttctccctcactgtgttctccatgctgctgcctggggctgctggccccctccctgtctgcaacggactctgacccctggaccaggacacccagcaggctccccaggaccacagattctgtctgaccttggggattctctggtgtttctgaaaattgctgaaagcttccagtggccattgctatgttatttgctagtcggctaaaaagttaaactccatttttatatggtctagattagaagagaggaagaaacactccagaggcatcagaggctcaagaaaatgcctagaatgaagttcagaccatcaagaagtccccggtggctcaggcacattcactgtttgttcattcctctgacagtcacggacagccccctgtggacaaggcatggtggcgggctggggacagtcttctactaggaggatggggaagacctgagaacagtgcaggaacagaaggaacaaatgtgcgggctgtgggtcacagtataataggaacacaggacagaggctgaagatggccccaggatttgagttacgaggccagtgctgtgctattagcaaccaaggggacctggaaaggattggaaggggaaggtcttgaggagaggctcctggtaggttttttctgatcaatagtcccaagggtcaaaaatatcaacagtgacagtcagtgctgggatcattctccctcacagatctgaacccttgagtatgttgattttaatgacagggacgttctttatccagccttatgcctgaccaactctgattcatccttcaagtgaggagatatctcttcaccctcgaagctttccctgatgcacaccccccgggccagggcctgccccagagctccccactgccaccatcacttccccagtgcaggcccttacccccgtctggcctgttgggcttattgactgaggcccccaccctccccagccagcagcatgcctgccccacaaagctatccagcaaatacagattgagacacaaatggatgaaagacatggaaggaatgtatggatggaatggagggatggagtggacacatggaatggatggatagatggagtggatggatggagtggatgggtagaatggatggatggagtggatggatggagtggacggatggagtggacagatggaatgggtggatggagtggatggatggaatggatggatggaatggatggatggaatggatcgatggagtggacggatggatgtaatggatcaatggagtggatggatggagcagacagatggagcagatggatagagtgaacagatggaatggatggatggagtggacagatggaatggatggatagatggagtggacggatagagtggagggatggagtggacagatggatggagtggacggatggagcagacgggtggagcagagggatggagtggatggatgaagtggacggatggagtggatggatggatggagtggatggatggagtggatggatggaatggatagatggagtgcacggatggatagagtggatggatggagtggatggatggagtggacggatgaagtggacggatggaatggacacatggagtggacggacggagtggacggatggaatggatggatggatggatggagtagatggagtggatggagtggacggatggagtgggtgaagtggatggagggaatggatggatggatggatggatggagtggacggatggaatggacagatggagttgatggatggaatggatggatggatggatggagtggagtggacagatggaatggacggatagaatggatggatggaatggatggacggatggagtggctggatggaatggatggatggaatggacggatggagtggatggatggaatggacggatggaattggatggagtggatggatagagtggatggatagagtagatggatggaatgaacgcatggaatgaatggatggaatggacagatggatggagtggatggatggaatggacggatgggatggatggagtggatggatggatagatggagtggacggatggaatggacagatggagtcaatggatgggatgggtggatggatggatggagtggacagatggaatggacggatggaatggatggatggaatggatggacggatggagtggatggatggaatggatggatggagtggatggatggaacagatggatggaatggatggatggatggagtggacggatggagtggatggatggagtggatggatggagtggacgcatggaatggacggatggaatggacggatggaatggatggatggagtggagggatggagtggatggagtggacggatggagtggatggatggaatggatggatgggatggatggagtggacgtatggaatggatggatggatggatggatagatggagtggacggatggaatggacagatggagttgatggatggatggatggatggaatggatggacggatggagtggatggatggaatggacggatggagtggatggatggaatggatggatggaatggatggatggaatggacggatggagtcgatggatggagtggatggatggaatggacggatggagtggatggatggagtggatggatggaatggacggatggagtggatggatggagtggacggatggattggatggatggagtggatggatggaacggacggatggattggatggatggaatggacagatggagtggatggatagaatggcctcctctttgtctaaaacccccagtagctacgaattcccccaacaactactacacactgccctgcacatgatcacgttcggtaagttgtgtgagagggcaggagggagaaaatggagctgcctgcctgcctcacgagcacctttcaccattttgatcacatttccagatgcagcaccaccctctgctctcacttctttcctcccagaccagggaagcattggatggtggttcatgaggtgctggaggagctaaagaaattgctgtcatcgttttgtcaaatccagggcctttatgttttaaaatagatatacaaagagatcacattttacctggtaaaatcatgacaaactgagcggacaaaaaaaaaaaaaaaacctataaacatttggcacaacagagcaaaaatcataattcctataattatttttaaactgtgaaactattgtagagcattgaatagatgtatattaaagccatgtatgctttatttgcttatgacatgaaattctggtttctgtgtgttccaccttcctattttattcttaggataataggatatgatgtgatgctttactcatagttagagggagaattgactgtgaatgagcagttcagagagaaaggatcttgggcttggcaagggcaggggcctccagcgttttgagaaaaatgaattgagcctcagcttattttataaaaatcttgacccagagcgtggcccttctgaactcccaccatgtttatgcatggtaatatattaaaaattggacttagctagtagccaaatacagtgctgtgttctggatactaaaacaaactaattctccctgctaagtaagaaaaatttcacacattatcgtcagtcagacatggaaagaggttctccaggggaagagagagaagcaacatcattcatgtgatttaaaattacaccaggccatccatttatctgcctctcaggctgtttgtccttttttgaacgatgcttcagggctccacgctggaaacggggagggtggatgtagaacagcttgtcaatgtaatcattttactataaatctgcaaaaaaagaaacagagcctaaaccaagtataaaataggatcacagaacctcctatgagcaactttgtaagattatcctttctagtgtgagtactaccacaataaacatgatgacatatcctttatcactatgttgcccaaagattttttttcagatttcagtggactcctcccctgccactcttaacagccctgctcctccaaacatagctgtatggagagagatgtccatcacagggatgtttatacaaaaacatcaaaacactcattttttcaggctggaaacggtggctcacccccgtaatcccaacactttgggaggacaaggtaggtggatcacctgaggtcaggagttcgagaccagcctggccgacatggcaaaaccccgtctctactaaaaatacaaaaattagccaggcatggtggcacacgcctgtaatcccagctactcgggaggctgaggtgggagaatcacttgaacctgggaggcagaggttgcggtgagccgagattgcgcgactgtgctccatcctgggtgacagatcagattccatctcaggaaaggaaaaaaaaaacactcattttttaggtgaagttaattgactgggaggactttatggaacattttggttcttttcctactgctgaaatttgaatagaaaggcatgaggtaacctcatgccatcactacgaaaggctaccagaaatgatagaaaacctcacacagtatcagctacattggtggagtccacctgaatcccagaaattcagttcaacaatgtcactgagttcaccagactactgggaaagggattcatgtagagacagttgtaaaaatattgaccctaacagagaaagattcactgcagtcagaagagatgccacgaagtcaggtctcaactcctggagaggctctttctgtgctgtgcaaaaatgtatgtttatccgacttcccaggccttgaggtacagcaaggaatgccagtgttggatgttctacaagtgaggacactggagcctcaagaaataatctgacttgcacaactcctgtcactgattagtggctaaggacatcctgatttctgctccagaactttccccatgacatcagtcttcccatccttgaagagttttcagttattcttagcgtgacaagtgattgctagagtttgtgtaattttcatcataatgggactaatgacccacaacagcagttctagtgacttccagaagatgttgtacatccccatcctaatgaatggcagcagcatgacttacgttcttttatcagagagtctagtttgatctgagttgtgtctgacctggaattcaggcatgtctggggctaggaaggttttgggttcgaggaggctgttttcatgagggatcccagggtctcttgggaaggaattcactcaagggaggacagaggcaagagaagcacagttcactctcggggctgaaggcagcatgggttttaggtgcagcctggtgacagtcaatcgggtggcctaccatgtagtgattaagactttggaaaagcaggctataagcaaaaatctaaatttgctacacaataacttggcaagacaatggagcagtggctggcaccatggaccttggtaagaaacactagaaaagttaggaaaaggggtttttccaggtcagagagagccagtgcatgctggtggacccacagttctgtagctatgagaaatagccccatctggttgtgcaggaaccacaggctgcactagctgctttagttgtgaccgcagaaagcaccctgccccagcatggagcaccagggcctgcacacctttgccaggccccagaagcactgccactgccatgatacccaagaagagagagattagcaagtgctttgtaccagaggggagggctgcccatgcaaaggcctgcctgggggaactccagcaatcattgggggagactttgggagagtggagagaaggggcctcctgaaaagacacagccaggggaaacctactttcatgatatcaagactctaattttagagggcagtgtttgcagatcctaccaatgactctttgtccttgagtctgtgtttgaggtggaaccactcaaagacggggaagatgaggcacctggagccaggcgcctggtctttgtgtctgcacttagccaaattccctctcagctgtattgtgtctggaggaaatagaagcatgactaagctgatttgtattctgccaaccaagggaaaatataattaacacggcagcaagactcagcaaaccccatgggaaagtccaagaaggaaagagctcccgtggctcaagatgatgtcagaggcaaagagaggccaacccactctaatcccacagcaggtctcctctctaatacctcaactcataaagggaaaagacaatgaaatccaggcctgccatgcctttgaaaagaacacacagcctctaggagtgattgcagggattgagcagactgtgatgggggttttctcatgatgggagtctcctgctgttgctgagtgctgccaatcactgcccacacctccagcagggaggtgacttcctcaggctctgctactccacatcaactgattaacgcagctgtgatagcacacctagcagagacaagagactcccagacactaggcaggagtgagaccaactgctgtatcagatatacacctagcttataattacgtgtcaagagaaggaagattaggcagacatcagtaaccgcaagaactgaaatgtgatggctggtatccatcttcagcctgctccccagctaatcatcccctaaaagaaatgcgggagaaagctgcctcctaatacatttcattggcccttcatctccgtctgctgactcacatttgaatttagagacaatttgctaaactttctagatttttatttacttaacattgccttagcctttttgatatattcaactatagtattctccaggtttaaatattgtacgttttttttcacaactttaacaaattagtgctcagttctcctggcttgaaattcccatatctttcatgaagctgttgaaactaaaaggcttaggaggaaggtcacccacctccctcattctccttcccttcttgcccagaggaatttatgtctgtcttcctgccccaatatctacatatccagccatgactacattgtttggtttaagtaactgcctctcattacagaactagattcatttattcattcattctacaaaaacttgaagaacatttatgctggatttgaatccagtgtcagaattgtctttgattggttctatcttatttcatagatttggggtttgaatttaatagctaagcatataaatataattttatgcaagatagcaccttaattctagtccttatttaatacaaatagtgatataatgaaatgatatagttttatctagtttcatctagagaaatatggaaggaaaaatacaaatagttaaaaaaaggaggaaggctgaaaatatatagcagttgatatgcttctcagagtcatcttttactaatcagtagcagtggtgatggtcttttaaaaaaaaaaagtttcggttgcttttaaaaagagatttccagtgggaagcctgtgagtactgactggctcctgtctaacctacacttcctgtttggttgatgaaaaagaaaaaaaaaaaagccaaaactaaaaggtacattccagaacaagtagtcattttaacaactggcggagccaagaaaatgcgatctagtttccctctgtcccccagtctagagccattattaaataatttaatgccatagaacttatatcaaaaatagacacattccttaggaaacatttgaaacttactggttttgaccttaaaatgtaatcattcatgaagagatcaatctttcatatgttttcaaatatgaaacactcaagtccattgtcagaatcccaatagtgtggaaagaaacctaccagggcaggcttatctctgctcattctttgctaaaatatccattgcatttgctaactgtgaaacgatgggtaggttacttcacttctctgagcattgaagatgccctgtctacaaaggataacagtctctctcccaggggtagctgtaattgtgaaattaggcaacatatataggaaggtgcctaatggagtggcaatcatttattcattcattcccgaaatatttatcgattggccacaatgcccaggcacagagcaaggtgctagtgatatcaacacgggggacacttcacatttccccccattcctccctaacggtgcagcagacaccccactaaagctgaggaggcccctgctgctccccctccctctctgctccctgagtctgtgagaggcatcgctccagcctcccaagaaagccctccccctgcacatccaagcagctccctcttatcctgatgccctgacccgcctgcccacaaggagcctcctccctgagccgggaggactttccttctctcctatgacaagccctggccctaggcagctgaaaacaatcacccaggaagctccttcaccgtcagattccctgacagccctggatctagcgagaatcaggtgatttcgatgtgaaacgaggtttgggaaccactgctttcagtcacattctttttgtttgatcttctcagaatcagcaggcatttccctctgctactttgtccaagatccaacccttctcatctgcgtcttgccagtctctccactttagagctttgttaccagctacttctaacctcttgcacagaaatctctactcaccactgtggagagtgaaaaaggaatgggtttttatgtatttctagccagctcttggccctgcgccatgcagagtatatgctgtacattggactttcgggacacttctctgttaaattctaagccttatgtctgtggtgtctccacagtgagtaagctcttaatcacattccctattgtaccttcttagatgaaagagcaatgggtcagggggactttttaaatgtccttaaacttgattagtttaatctttattatggctacagaatgtttcttaaatttacatacgataaaatccactattttatattaagtagagttatgagttttgacaaacaaatatattcaggtagccaccaccataatcaacacacaaagcaatccattacccccagatttcccttacatcctttgttgtccccctcatcctgtacttccagcccctgagagccacttatctgatttctgtcccgacagtttgccttttccacaatgtcatgttatataaatggagacatacaatatgctgatgtgagcatttagaaagatcatgtatttaaacaattattagagtaagggctggctatggtgacttaattttttggtttctgacacctataatctgatttgaagtgtgtcattctgtgcatcatgatcctttttgcagaacctgtgtctattagaaaatccagatgaagcaggctcttcctgttgtccttcatttggaaaagacagaagaacagagcgctttacgaaagtcaagttacagcttcctaattttctctcccatggacaaactcttccctccccccaccccgacctagcctcttacccactatcctttgcaaattcctatctcttatattgcccagtaattggggcgtgggggggtgaggggggggtgagttactgctgatgaaccaggaggcagagcaaggtttattttgctaaaggcttcagctgctactgcctggacctcaataagcattttctgctctttcctatcactactgtcttccctttctttgagaagcaacataaagataaaaagaaaaatacttgattttgtagcatgccagaatattaagatgctcctgaaaagtgtgggatttaaggcttctcaaaaaagagcagaggagggagtgagagaagaagacggagaaggaggagaaggggaagagaaaggggaggtggaagaagaaaaaaccaccatcagaaactgagtattacacaggacgtaacctgtgctctgagagtgaaggaggccacacagcagtagaaccccgacaggaaaatcagaaaacattatattttttcccagatcccagagtatcagatgttccattcagaaataatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgttaaatgttaacagttaaatcccacacttttcaggagcatcttaatattctggcatgctataaaatttttgagacttgtttaaagaaggggacttcctttttaatttagaacaaattagtagttgttataacattatagatactaatcagtaacaatactagtaggtaatgctttctgtaagtagacacaccccaaaagtatctgaaaagtatcaccaaaacggagcgtgctttcacactcctgcaaaacaaattagcccttaaacagaataattaacatcccgagggaagataaagcatataggttccttgaatcattacgttacatttaaagtcggtcctgttcagtttgcctttgtccctaaggagtaaaaatagcatcaaattgcttgtttggttttccccttttgaaactcagcatagtgtttggttatccatgaaggtggctttaatatttcaccctcatatttggcagacagttctggacttgctcctctccccgtagggactgagtcccactggcagtgtgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaagctcatggtctttctatactaccttagtagtatagaaatgttctaactttcacattcccggatgtctgagctcaagacaaattttaaataaattagcgtggctttgatgttctctcactagtgaaagggtctataacactttaggcaaaatgcattgaaattatgttaaaccttcatacactgccaataagcaatgacttcccagaaaccatactccacatttgacccagtctctaatttagtgagaaggtgagatgcatggaaagaaggcaaaggagagtgactagtgacccccagaaaagggaatctcttcccgaggtttgtgttgtgccctgtggagctgagaggagagtagggaattgatggagcagaggcttagccaacgcatctgaaagagaagagtgttttatgtctttaatttcttcttgtcagaatcaaccaagcccagagctatttacgtgttgagaagggtctcccatggagaggccttcccagtggcccttctactctctgctgcggtggtttatcatgtcttcaaaacagactcgccaccaggcttccaacaggataatacaaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacacatcacaaactctatttgtcctccaatgctcagtgaccttattttcccaggcaaaagtggctcccgtcccggtgcccactaagccttgataccagcccacagtacagtgcttctcagactaggtcgtctcagcatttgtcaatgtattttatttatgtttcgacgtccagtctgttcatcttcagtacaggactgggtcatactcatctttccatcctttcccttgtccaccttcctttcttcgatttgaatattttctgtagttgctccattaatcagtaattaattaattgcagaaatgtatttcccaagatgtagataagtcacacctcagaatgctacaaacatttgtagatgtgactgatcagtaattgtcaggagactttgtcaatctggagaggtgctgaaaaacagagacaagaaaatgtcaactttcaaaaatactcatttaaaaaagtagtttccaagaaaagcgtagactggcaaaaggatgattgacaaaattctggactagattactaaataggtgatatgtgagaatttagaggagaatcgtgtgatttgcataatccaacatgagttccccggaatcaagccatcccatgtgaaccatatatctcttttatatataggttctgaaactggtgaaatggggaccacttgaggttagagattcgtaattcagtgttgcctctgatcagcctggaattgtagtttatatgccagcaactgcatgtagcctgagggctcccatgactgggctacagccaattgatcacaatctaatgatacccctaggagtgccttgggtgagagcgttgtccggggcaaaccttatgaaactttgtcagatggtcttcacacagcatttcttgattttagcagagcctttgactcagtctctcctagcagattttttcacttactccacagatatttatttaggtgtttattcagtgtcaagcattgtattaggtgttcagtgtttgtggctcagaagcaaattctgacttagttgataatatggagagcaaaaccgagtcaaaaattgattgcctgaaattatctttggaactgcaggaagtcaatcgattgatgaattcatgtgtgtccgggtctctggggtacactgtgtgctcccccattcactccagtccctgctcagagtccttctccaatcacctcctctataaaagcaccttgccccatcatttcctattccctcatgctgttttatttttcatctttgcacattttattctctgcaatgatcttattcacacaagcagtcctgtagttgcctgctctctgcccccttgcttggaatgtggtatgaatctagggaggcatttcacagggctgggtcttttgttccttgccgtccattcaatatgtctatcagtgacaattgttgtcattcctgctaatctaatttgcagatgatagaaagtgaggaggcagagctggcatggtaaataaggggatcaaaatgtacatcagcagcatatgtgaaagcactttgataattgaagaattataattaaatgcaagttatcattttttaagtgcgtataaatctaagccaaaaccaataaaatgaaagtatcaaggttaaatataagctcatgcatttaggttcaaaaaatcaattacacaaattcaaaataaaggagacctaagagggcagcacagtccatgccgcgatttagccatgagctgggcgactctagggctgcaacacagtccccgagtggtggagccatggctggaaattcttcgaatgttatcagttaggagggccacatggtgaggtggacattaccaagcccgagtgtggccagtggagggtcactcagaacagcagcaggaattgggacgtttagcctgaaggagaggggacttagggaggtggggacccatctttaactctctgcggggttcacatggaggagacgggcatgtgtgtgctgagtgctaagttagaacctctgggtcctggggggcagactttcattcaaggtacggagaatgatgggagcccagggccagaagcctataacccacagcatctggacgaatactgagcgctgtcactagattctatttttatttgtttgtttgtttgtttgtttattttttgagacagagccttgctctgtcacccaggctggagtacagtgacgcaatctcagctcactgcaacctctgcctcccaggttcaagcaattctcctgcctcagcctcctgagtagctgggactacaggcacccgccaccatgcccgactcattttttgtatttttactattttactctactattttagaagagatggggtttcgctatgttggccaggctggtctcgaacccctgacctcgtgattcgcccatctcggcctcccaaagtgctgggattacaggcgtgagccaccgtgcccggccgtcactagatatttaaagagaaactggacaactgtggggcagaggccagctcttaagagggatcctggctttgggttggatcttcaattgtctttgttctttgtctttccaagtctaacattcttatctgttctaaacttccgtatttttatttgttctgactgatttttttttcttggtgtgacatttgatgtaaatagtacttagcaggcttagcaactcctatatgaaagtgctttgaaatttgctgggctttggaatctctgttgtttttgcccattaagtaattccctcccatccctcttcaatgttcccctttccctatcaaccagccctttctgcaggttggagtttgatagacttggcacttggcacaccccctgagcgccagtgtcaccctctgcgttgtgaatttatagatggagaccccttcatccttttacagtcgtgctctgatcctggggtccctgaggtccagagcagaacctgaactctgagtatcaggcaagcgcatcttacttcaaaaaatgggaagaacaatttaaaaatgcaacttggatatgtttttataagatattcccgctttctgttttctacacttatttagcattttaacattttcagaatacgtgaaaattagatttagtttcttttttaaatgtgaaatataagaaaattatgattacccgtaacacatttgtgattaaaagtacattttttaggaaaaaagtattgtttccagggaacaattttctattaagttggtgcagtaatgattgcgatttttgccattgaaagtaatgcttaggccgggtgcggtggctcatgcctttaatcccagcactttgggaggccaaggcaggcggatcacctgaggtcaggagttcgagaccagcccggccaacatggtgaaaccccatctctactaaaaatacaaaaattagccaggtgtggtggcaggcacctataatcccagctacctgggaggctgaggcaggagaattgcttgaacctgggaggcggaggttgcagttagccaagaccgagccattgcactccagcctgggcaacaagagtgaaactccatctttaaaaaaaaaaaaaaaaaaaaaaaaattaatggttaaaaccacaattacttttgcaccaacctaatacttagaaagatgcaataatactagatggttacctttaacttacaggtttcgggtttcacagaaacaacagcaaacccaatagtgcttcactcagtttccctcccaaagacagcaaagagagaaaattaactacctggccaggcgcagtggctcacgcctgtaatcccagcactttgggaggccgaggctggaggatcacctgaggtcaggagtttgagaccagcctggccaacatggtgaaaccccgtctctactaaaaatacaaaaattagccaggcatggtggtgggtgcctgtaatcccagctacttgggaggctgaggcaggagaatcgcctgaacccgggaagtggagattacagtgagctgagattgcaccactacacttcagcctgggtgacagagtgagactccgtctcaaaaaaaaaaaaaagagaaaacaaaaaaccaactatctaaggcagaatggtaataaactgcccagtaatgctttcagggataattaaatgagtgatgagggcacaattacaaataagctaacccgagttacttggaaagcagatggaagcacccaagaccatacaacaagaatgaaaccccagaacagtaaacacacggtattcctaccatatatgccccccatcggtgtcacctaaaccaacatctctttgaccttttttttactcatgtgaccagttatttgattgtttggctgtcaaagtcacaccaagataataaattaggcctttcagagccaaaattatattatctagggtattacagtgaatatagagttaaataattttagtgtcctgaaaacattacaaaacacatatcagaaataagagccattctatgtagtgaatcgggggagaaatgagagaagctcagagaccaacatagagaaaagcaggagaaagcagaaagcactggaaacaaacatgtctgcttgttggtggtgggcgatggatacaaagatacccagccagaatccccctggaacaagccaggcattaaatctttacagctggagttgcattaaatctttacagctctaagctgcttgctgcaaacatcctgtagttctcgtcaattcaaactcatccccaactttctttttttttctaccttactcagtgcgtctgtgtctgggtgaacttcagaaatctctctcttacgttttcttgcaagactctttggctagttttatctgaaagtttgtttgtttttccagctagtagttcttccccctcttccctaagctcttgaagtctaacactgtttctctggtcagagggatcagacaaagagagctctgctcccggccacccatccgtctcattgattcaagccactgggtctgagtgggccccatcagagggtgtgatgggttccagacaacctggacgtgcttttagaaagcagtcaagagtaaatccataaagccttatctttgtgttggaggggaccacattataagcaaatcgtacattttcttccaatacaaagtaagatagtttcctgcattattagtggatatttttgcaaggacatatttaaaaatatatattgcccaataacccatcattcagtttaattccacatccctgctgggtgccttccagtctaccttgggcaacttaacataaatatggaaaatatagtttgtgtttatggagctcatcgccctatgagagaggccaggccctcacggaggacgaggtgacagcgtgggcacagccagctcttgaagaatatcataggtgatgaatgctctagagatcccaaggccaaagcggctcaggcacacgtcattcatttgtttgtaagcaccgtcaaggcaaagagaccaggcatctgtctttcataccccagccacaccccctgaagcagagtagataatagatgcttacaagacagcgagtgatttcatctcagtatgtatgaacagcttcaatcacacagattttgggcagattcactacctaatcggatgcgagacttttcatttcttctgacctatattagtaaacagcaatataatcttttctaattacagacacataaaatgattgataaaatccaacaattgtatgacccctccacaaagcattttttacattcaagcctcacaccagcccctggaaatagatattatttttaatcttaattcatccagcattgtgctgggtgctggggatagataggccagggaagaaagattcgaagcccctgcttttatggagctgacttgctggtgagaaaaaaataaataaataaaacagcaaacaagaacaaacaaatacatcaataatttaagtcattgttaaatacgatgaaaaaaatggtagtatgatagagagtgatcaagggaggaagtgagatctctagagtggatttgaaggaaccagatctaaagacagggggttccagttaaaggtataataggagtgtccaacctttcggctttcctgggccacattggaagaagaattgttttgggccacacgtaaaacacactaacactaacggtagctaatgagctttaaaaattgcaaaaaaaatctctcttttttttttttgagacagagtctcactctgtcgcccgggctggagtgcagtggcgctatctcggctcactgcaagctttgcctcccaggttcacgccattctcctgcctcagtctcccgagtagctgggactacaggcacccgtcaccatgcccggctaattttttgtatttttagtagagatggggtttcactgcgttagacaggatggtctcgatctcctgacctcgtgatccgcccgtctcagcctcccaaagtgctgggattacaggcgtgagccaccgcgccaggccaaaatctcatgatgttttaagaaagtttacaaatttttgtttacaaagccatcctggaccgcataaagcctgcaggccatgggttgaacaagtttggtatagcaggaccaaagaccctgaggtcagacaaggccggcatttacctgaacagaaggaaaccttgataaatagaatgaatggggaggagaaaagtagaagctgaggtcatagaggaggcagtggccaatttagcgagagggcctcacaggccaagggcaaggggtttgaagtttattatgagttgatgggaggtcagtggagggctttgatgtatcattttggcctctgtggatgatggatggtggggagaccatgagtggaggcagggaggctagcagggaggccactgctggagtttagtggagagatatggtggctttaatgagaacataattgaaggtacaaaaatgggcagattgaagatgtatttgggaggcacagctaagactatctgcggatgtattcggtgtggggaatgtggaagagagaggctcaaattcccaatttatggttgaaactgacactcaaagggattaaggaatttctgtctacagccgcaaatacagggcaggcaaggactccaggctggttctctaattcccaaatgacagctcttctcattcttgcatgaggatatgaggtttgcagaaagaagggattcatgagtagtaagtcctcttaatcctcctagtatggatctaatgattttttgaggtcatgcgtagtaaacaatgtgtaatatccattcaactagtcagctgatttgtggttacttgcaataagtcattattttcaatggggtcgataatactgtctctgacactaggtgtttgtaaccacaaagtgcacttcagttgaattcctttccgaggttgttttatgttcagaaccaacctttcgtagttatatcattagttattagagggataccaggcaacagatcgagtttatttcttgtaagcgttcttgttgcagtcatatatttcgtggtttcattaaatcggccttggtagacaagctgttctttcaaatccctctgtgagcagcaaatgctgtggattgagatctgtattctccagatgatttgctaagtcatctcagaagagtcctctgaactgtgaggtgtccccagcccttttgtcccagatccaagaaccaaaaaaagaacttgaaatggggatcctgctgattgtgcctacacttgttcattcatttcataaatacttactgggccctccagtgcacaccaggcactgttccaggtgctggagagatacaagcgagcgagagaggtcaggctgctgccttcagggggcttcttattcgtgggcaaaacaagcatgacaaatgggcaaacaagattatcacagtttaatacgtgataagttggtcaggtaaggcctgataaggcaacttatcacgtatcaaggttttggcctctgtggatgatggatggtgggaagaccatgagtggaggtagggaggctagtggggaggccactgctagagttcagtggagagatatgaccaacttggttaagttggtcaggtaaggcctcctcaaggacacggcacttaagcaggaggctggaagtataacaaagcagctatgagaggagctggggaaatgcatcccagggagtgggaacagcgaggacagagccctaaggaaagtgtggtgcattgtttagtaccctgttggctgctataatagagaaacccaggccaggcacagtggctcatccctgtaatcccagtactttgggaggccgaggtgggcagatcacgaggtcaggagttcaagaccagcctgaccaacatggtgaaaccccatctctactaaaaatacaaaaattagctgggcgtggtggtgtgtgcctgcaatcccacctactcaggaggctatggcaggagaatcacttgaacccaggagccggaggttgcagtgagccgagatcacgcctctgcactccagcctgggcaacagagtgagactctgtctcacaaaaaaaaaaaaaaaatagaaaccgagactcacaggggtttaagcaagatggatatttatttttctgtcacttaatagcatgggtggacagttcaggactgatgagatagctctgcaatattttgggacccagactctgctgtgctacaatctggcattctcaatatgtgacccctacctcatggtccaagaaggcttctccactcctgccatcacacctacttcccggccattcagaaggggagaggggaagagacggcctcttccctatgtagaggcataatatccagaatttgtgcgtatcttctccaaaggagatggaatcagataagtgtgtggtaggcaggtcattcgggaccatgtagatcatgataggatattgcgttttattccaagagcagctggatgccgctgaagggttttaagtagtgaagtgacatggtctgatttatgtttttacaagaacactctggctgctgagtggaggatggatgagtggaggatggatgacagaagggcaaaagtggaaatggaagatcatttaggaagctgtgatcttaaggagcaaggcaaggtggactcagacactgagacatcatataattgtagctttagagtattaactgtttaaagagacaatgagtaaagactgaatgttcatgcacctctttctaaaatacagggacagcctttgcgtggacaacttactggatgagcaggtttaaggaattgtatcctataaaagatagacgtgaaaccagccaatgtgaatgtgccgccaaattggacctggttatatttgtggggacccttaacttaggaatatagaaagcacatgaaagtgcctgtcaagctagagccctgggcaggggcaggctcagtctcccaggaggttagagctggaggccctctgagctcatggattcaacccttgtgctgcaggtggagaaactgatggtaggagtatggggggctgtggcttgcccaagttcaactttggacagttgcagaatcaaggcaggaagccaggactggaagccgccactctcaccatgcaccgtgagggggtatccttgatgggatgctttctcctgaatcacacatttaccttttggcctcctttgccagcacctcccttagaacaagttcccttctttacctttccccaaagtcccctggcctgtacctcaagtgattccatcagttaccttgtcttccaaacaggactggccagatgacgatggtaaagtgattttgagagattataactcacgtttgctgaaatgttttgaagtttcaagacagtagtatgcactgtgaatgccagtgttgctcaagatcctagagacagccctgggtcctggagccccggcagcctgctccaaggtcaacaggcggggccccggcaattgtttggggaccattttcacaaccttaaggtaatttgtggttcctctgagaatgcccactgaagtgttccccctcagaatgctgtggatgggagatagaaggaaacaaaagaggaggaagcagtgaggattttactggatactgcagatgcacttccacatcggcatgggttcatactggattatgcaaaagtatggattctggaatgattcattccccccaaaacctggaactcgagggcagcatgctgcctcgttgtccataaaacactcccttttgtctctgcagggatcttaaaaaaacaaagcaagctttactgtggcaaaacctcctctacatattatcattgtctgattggattttaagcacaatgctatcttggtctacacattttcttatacaagtgacagtaatactaaaaatctcagaattattatcaagagccttttggtagggtgaaagtttcttttaagtattttcattttcaggagtgagttttcacacacacacacacgcacacacaagtatcaggaaacaaaaaggaaatgtgtgcaaacttccaatttaaatgttctacatcttagttgagatggctatgatacagatacatgtatttggcaaaactcatcaaactaggcatttaaaataagtacatttttggggtacaaattatacctcaatgaagttgattcaaaaagtcaaaagtaaaccaaaaattccaattttatattccattaataagtttttggtgtctgcttctggttttattaccgaggattctcatttgagtacactcagaatggaacagagctattatcatcgaacgtttcctatactgggactaaagtctggccaggaaattaacttttaaccctaactttgtgctattttgagataaaagaaatgcacacctcagaacagcaaggtgttacagcacataactgcctgtacaatttaaaaactcgataaacccaaagctttggtagcaagtcttagcaggtgctgagaaatacgaaacgattaatttttttttttttttttttttttttttgtaaaccagaaaacaagtctggtgttaagcctgttgtgcaaatactagcattaaatattttgtagcatatcttagttccaagtatttcttttctgtcacatttttctggttcctcctgataatcaaggcaatattctttgaactgtttccttagaaaagttgttgaaatgaccaaatttctaattccattgggatttggacacatttctgaaatggcccagaaatcattttggggagcccttaggctgctgttccaatccagcacataggtgtgacagcggagacccactcggacttcagggactgcctgcctcctccctccacacccatctcctgtctccccaggacctgtcctcaggagctcaaaagaagaggggtcttggtcctgagagggtgagggggcgaccgggaggaagcacttcctctctgtttcttaagacatctcccttccctgggacaacttccctaaaaggctttctttttttttttttaaccacttttccaaagtcagaaatgaatacattctgaaaataacccaactttctttttatgtttctttctttccacccccacctcaagcccctagaatggccagcccacctggctagcaagaacttaccttcctgagcatgcctggggacagaccctagcacacaccccaccctgggctcgtggcgggactctggctctggccaacatggagatcccagccacacactgatttggaggcctgagtgtcaatgacaaaagcaatccaaacccaaaactctcaaaattgattaaacaatggaaagcttggctttacatgagatgtgtggaaagcatcctgcatccaggtactcactggaaggcagaaatttagcagatgttgctattattatccttagggttaatcatagtgattcctgacttacagaatccaaataaaggaaatccacttcatgcatcagccgccagctgctttttttttttttttttttttttttttttttttgagacggagtcttgctctgtcgcccaggctggagtgcagtggtgcgatctcggctcactacaagctccgcctcccaggttcacgccattctcctgcctcagcctccggagtaagcccccagctgctctttgtggacactcattgcccagacccccactatggtcgatcagtattaattgcattaacagatttaattataaaattatttcaactgcctgtttttttctgtcttccattctgtgttataatagtttgccaggttagctccaaacacttaatgtctgttacttactcaatataatcccacccagtacatcacctttactgggaaagaagcttgttaatctctgtttaccagtctgctcccagttattcaaggactctctgaacctaaaatgtataatatgacctaggtcagaatggcgttcccataagtgagcaccaacagtacgcagcggctgacacgtgtgaatccatctcttgttcccttgaactgtgaatcaacatggatgtagccatagtcatatctatcaccttttgtgagaaaaattttactttgaaaacaaagtaatagactgtacagttaaaggacagcagaatccagcaaaggtctgtctgtatcacaaaggaaagccacatcatgtgctttattcccatcatcagtcaacatccattttttgtagctctgggaacctaggtgtctgagagccagcgctgcgtattggtagcactggttctgccatctctaagccccaggacaagtatcctaacagaactaagccctggcttcctcatctgtaataaaataagtaccttctagtattcttattttattgtgaaaagacaattctgtgcacatatggttacacacacatagactataatgacacttgcattttattggtattcacaacttttaaaaattttcctatttaagacacagcttaaaataattaaaaagaaatcatcacatagttattactgaagatttgcttctatgttccataaaacatggttttaaaatataaaaaaaagacacagcattgatttccttcaatctgcactttttttcccattttgctcagcacacaaccttttaactcactcttaaaaaaaatccaccataaaggactggaaattaagagaagggtgttatataaaaaatgccatgtgtgctctgacttacaaagtcttcttcagtccatgaactcacagacagtgtcagccactgagagtgtcgtcgtcaaaacgaataatagatgtggaaagccgtggctcctgctcctgagagctggacgcctcttggctgacctcctgcttgagccagatccaagaggtgaaggctgaagcaagagagctcccttgagaaagctccagagtttgtagcctactaaaccagcagtgtcctatattacattaattctcctgatgtattttcctgacatttgtcagcatttccttctatttgccaaacatggacaaagagaaaaccaggttttagaagtatgctcatttataaagtctctcctgagtcctcacctttccatcccttctgccatcacctcagtcagacccttaccccatcactcaagacagctgtaagtctcctggcttgacacttcgcttcaatctcactcatctctgattaaaattgtcccatgatcgaaaattttatgttgttttcgtcaccattaaaaaaacaaaaaaacaaaaaaaaaaacccttcctcttccaagatgctccagtgcttaacaaatcaagtgtaaactgatttgaagcgtgaggccctgcgtgatatatactgtaggagacctttccagctttatccaatatccatccctagtactttgctgttaccccatgatatggtttgactgtgtccccacccaaatctcatcttgaattgtagctcccataattcccacatgtcatgggagggacccagtgggacgtaattgaatcatgggggtgggtctttcctgtgctgttgtgatagtaaatgagtctcatgagatctgatggttttataaaggggagttcccctgcatgagctctcttgcctgccaccatgtaagatgtgattttgttcctcctttgcctttgcctatgattgtgaggcctccccagccatgtggaactgtgagtccattaaacctctttcctttataaattacccagtcttggttatgtctttattagcagcatgagaacagactaatacaccacacatgctcattgatttcttggttttgtgaaaggcccatctccctctcccatcagccttctctttgcaaattgtagcccccgttcaatgatcagttcagttggcactgacacccacaggcttcccttgatcctgtgccccaatctagatccatagctctctcctctggatgtccttcatgtgactgtgcatcatagccttctgtattttgcctcggtcagtgtttattcttgactatgagatcctgcagggtattgtagtataactgtttctctgtgcctcacagtgccaagcacagggccttttgtatagagcatactaataaaatttctgattccaactaaattcttgtatgcacacataggaagtgtgacttaatatatgcatatggaatcaaaatgattactttatagttagcatgtgtatgtttgtatgcagaaaattcaaaacaagtattcaaacaagcacaaagttgtgtaactaggaaaaacacatgctcatttactcctgacctgtggggcccaggttccaggccctacactatgtgatgaagacacaagacaagaaaatatggcaccttctttgagaagcttccatctagtcagggagaaaaacctgtgatcatataactgtagcaggccctattactcctgactacactggagaggccaaaaggagcgtgcctggttcagcctaggggtgttcaaggtggtcgtatcactggctgagggagtgtctgagggaacacacagccagggggctgggagaagcagggtgggtcagagcacaaagagacttgttcatcatttcgaggcgcctgtgctttctactagagatagtcactgaagcagaatgagaggatcctacgcagtttcagaaacatccccctgagggccaggtggaggatgaaatggggggaagaaggcaagatggcgggcagccatgagaccatggcaagaactctcagactggaaatgaggctggcttgagggaaatgggagacgggagcatttgagaatgtggagattgcatgagaagggatggcttttgggtgagtgaggatggctggcctgcctgttcacccgctgggagcctggtgaggtctcatccacttaccatgttgtctgggctagagagaggtagcacctgtagaaaccgcaattaggggtcctatgcttttgtttaactttctggaaatagaacaggcctcccttttaatacatctgttattcagcctttagatattctgctttcaagcgcgtaatcaggaatgcattagaataaagcagttaggagcagagtaacagaagggttaaagtatttaacttctccaggcctgtttcctctgtaaaatgagaaagaagataataatagcacctatttcacagaggagctacaaaaattaaagaagttaatgaatgtaaattgctcagcctagggccctgcataaaatgtgcacttaagacatcagttacttttttttcctgtgtgattggtgaggaaggttgagaaaagcatgaggactccttagctcttccgaaatacagtcatgtgctgtgtaaggacgattcagtcaaccacagactgtgtgtacagtggtggtcctatgagattataatatggttacttttactgtaccttttctgtttaactacctgtagatacacaaatactaccattgcgttacaattgcctacagtattgagtacaataacatgctctacagatttgtaacctaggaaccatagaccttaccatatagcctaagtgggtggtaggctctgccatctaggtttgtggaagtgcattctgtgacgttcccacaataacaaagttgcctaacaagactcatttcacagagtgtatccccatcactaagcaacacataactagtacttgctacagttgcaatataggcaaagcctcccttcttaaatataaataagcacacttttcaattcggagatgtattttgtatactaaatttgaagacattgttttgcctttttgtagggagagctggagattctgctcttatatccagagtggcatccgtgtgacatagtcattctttgtatgtgtgcctttagcctatgggtcattgtcagaatttagaaattcaaggtgcagccagttacattgctagagagatggaatatttcagagtctctgcaagcttcctttaagaaaaatgtcttcttttggaaagccattcagaaaacatactcagtaggacagtttcaacttattaaactttcaggaaatttttttaattgtctcacactgtctcttttgctgtataaattttaacagcagggtaaagagagaagcgttcttgaatttcactagctgcggagaaaatatttctcactgccctgggatacataggaaatcacagtcgttagtttcagatgtttagtttgggatattcaggtgcattcacaataccttttgattcattattactttaaaccatttgtggtttgatcctacaaattgaggacttttctccagatgtgaaaaatacaataaaattttctaacagaggggatctcgagaagaagttatctttatttctgcagtttctacaagagtccataaacccctttagaacatggcaaaaactgcagattggcagccatgggttggctggactgaaagggaagggggctcacatttaatttagagcataagaataagctaaacagcaaggcagtgacaaatgatacaacaagcaacaactcctagctgactgctccgaaataaacacatggattccaggcctcacctagaccaagaacatattctgcaactaaaattaaaccttcgggacatgcaaactctttagggaaaggagtggaagaaggagaagaagaaggaactcagaggttaccaagcaattgagtggtgaagagaacaggcatgaagaaaagagaacaggtgtgaagcaacgaaggaaattgcttctccaaatgaaaagttttgaaacacagccctcaccaacctcagaaaaatgctaactctgaaataggaaatggagacggaattggaaatggaacgtgaggaatatcagtaaacccttgtaactgtgcgatcaacttctttgtaagatttttaaactcaaaagtaaacacttttaaaaacttaaaagtgtaagattttaaagtggtataaagatcttaattaggcatttaggtagtgcatgctgtggagccccaaacttacagaagtgacaccagaaaaagccagaatgatccctttctgtgttccagtacttgtgggaaaaaattatttttattaatttgtaaagggctaaaatatttatggactaaattcagatgagtaaaaagatgaaggtgttagagtcgcttttctttcttttttttctttttcttttttttttttgagacagtttctctcttgttgcccaggctggagtgcagtggcgtgatcttggctcactgcaacctctgccccccagattcaagtgatctcctgcctcagcctcccaggtagctgggattacaggcacccaccaccatacccagctaatttttgtatttttagtagagacggggtttcaccatgttgaccaggctggtcttgaactcctaacctcaggtgatcacccacctcaacctctcaaaatgctgggattacaggcatgagccaccatgcccagcctagagttgttttaattttctatatcgggtctcatcttgttctgaggcatccatttctatgttcttggtttgggttgaggggagattgaagcttgcacttaaagtcaactaagtctctcatttaaaaagtgtttcttttaggtgaattcagtctctctgaggcaaatactcaatctctctgccttcatatctcctttccagagtgtcaaggggcccgggattacacgcagtcttcagggtctgtcttcatctcctaggctgtcataacaaagtaccacaaactgggtggcttacagcaatacagatttatcctctcacagttccggagcccagagctctgaaatcagggtgtcagtaggggtgggtcctcttggggactcagagggggaactgttcttctcttccagcttctgatcgttactggaagaccttggtttttctgggcttgtagaagcataattttactctctgcctgtgtctccacctgcctttctccctgtgtgtgtgtctgcgtcttctctttttataaggacaacagtcactgggttagggcttaccttaactaaagatgacctcatcttaactcgaccattgtattagtccgttctcacgctgctatgaagaaatgcccaagactgggtaatttgtaaagaaaagaggtttaattgactcacagttctgcatggctggggagtcctcaggaaacatacaatcatggcagaaggcaactcttcacagggcggcaggagagagagaatgagtgccagcaggggaaatgccagacgcttataaaaccatcagatcggccgggcacggtggctcacgcctgtaatcccagcacgcctgtaatcccagcactttgggaggccaaggcgagcagatcatgaagttaggggttcgagaccagcctagccaatacagtgaaacctgtctctactaaaaatacaaaaaaactagctgggcatggtagtgcgtgcctgtagtctcagctacttgggaggctgaggtaggagaatcacttgaacctaggaggcagaggttgcagtgagctaagattgactctagcctgggcaatagagggagactccatctaaaaaaaaaaacaaaaaacaaaacccatcagatctcatgagaactcactatcacgagaacagcatgggggaaaccacccccatgattcaattacgtccccccaggtccctcccttgacatgtggggattacagttcaaggtgagatttgggtggggacacagagccaaacagtatcaaccacatctgcaaaaactgtctttccataaaaaggtcacactcacaggtaatttgacatagctttttggggcacacaactcaacctgtaataggatccttacaggtctttgctgtggtggctatgctggtctggtggccacccttgtggcgctgaggtgctgaggttgggggatgttctgccgtggcttattaaagggcatagtgctagccatctcccattcttcctgcatctgtactgcgtgcaggctgcaggggagcacagcactacctaagccccatccaacagacaagtgtggctctcttaacagggggacttactactcgtgtgccaaattcaatgctgctaataggaagcttgaaagcaaacagtctatgctttggcaaggaggatccactctcactccagccccatgtttcaacgtttaaagggaagccagaatacatacacagatggtctccaacttatgatggtgcaacttacaacatttttactttaccatggtgcaaaagcaatacccattcagtagaaaccgtcctttgagtacccatacaaccactcttttcattttccctacagtattcaatagattgcatcagatattcaacatgctattttttttttaaacggagtttcgctttttgttgcccaggctggagtgcagtggtgtgatctcagctcactgcaacctccacctcctgggttcaagcgattctcctgcctcagcctcccgagtagctgggatcacaggcatgtgccaccacacctggctaattttgtatttttttagtagagacggggtttctccatgttggcctggctggtctcaaactcccaacctcatgtgatccgcctgcctcggcctccctaagtgccgggattacaggcgtgagccaccacgcacggcctcaacattctattataaaataggttttgcattagatgattttgcccaattgtaggctaatgtaagtgttctgagcacatttaaggtagggtgtgtttggtaagttgagtgtattaaatgcacttttattctgacaatatacaagacagtaatattattttttgactgaattagtggctgaattaataagtgaaagacaaaaggactgcttttgcagggtgagctcaaaaacgtacgatgggtttactgggatgtagccccttcatgctggaggaacctctgtacgtgtgtttccttagggctttgcaatcactgttccttctatctggaatgcttttttccttgggttccttttgagaggtgacagcgtgctggcagtcctcagagccctcgcttgctctcggcacctcccctgcctgggctctcactttggtggcatttgaggagcccttcagtcccccactgcactgtgggagcccctttctgggctggccaaggctggagcccactccctcagcttgcagggaggtgtggagggagaggcacgagcgggaactggggctgcgtgcgggccagctggagttccgggtgggcgtgggcttggtgggccccacactctgagcagccagccagccctgctggccccgggcaatgggggacttagcacccgggccagtggctgcggagggtgtactgggtcccccagcagtgccggcccaccggcgctgcgctcgatttctcgccgggccttggctgccttcccatggggcagggctcgggacctgcagcccgccatgcctgagcctcccacccactccatgggctcctgtgcggcccgagcctccccgacgagcgccaccccctgctccacagcgcccagtcccatcgaccacccaagggctgaggaatgtgagcgcacggtgcaggactggcgggcagctccacctgcagccccagtgcgggatccactaggtgaagccagctgggctcctgagtctggtggggacatggagagtctttatatctagctcagggattgtaaatacaccaatcgggactctatatctagctcaaggtttgtaaatacatcaatcagcaccctgtgtttagctcaaggtttgtgagtgcaccaatcgacactctgtatctagctgctctggtgaggacgtggagaacttttatgtatagctcaaggattgtaaatacaccaatcggcactctgtatctagctcaaggtttgtaaatacaccaatcagcaccctgtgtttagctcaaggtttgtgaatgcaccaatcgacactctgtatctagctgctctggtggggccttggagaacctgtgtgtggaaactctgtatctaactaatctgatggggatgtggagaacctttgtatctagctcagggattgtaaacgcaccaatcagtgccctgacaaaacaggccacagggctctaccaatcagcaggatgtgggtggggccagataagagaataaaagcaggctgcccgagccagcattggcaacccgctcgggtcctcttccacactttggaagctttgttctttcactctttgcaataaatcttgctactgctcgccctttgggtccacgctgcttttatgagctgtaacactcaccgcgaaggtctgcagcttcactcctcagccagcaagaccacgaacccaccagaaggaagaaactccgaacacatctgaacatcagaagggactgactccagacgcgccaccttaagagctgtaacagtcaccgcgagggtccgcggcttcattcttgaagtcagtgagaccaagaacccaccagttccggacacactttcacctggctcagagctcaaatgtaatctcctcagagtggccttccctgctcctgctacctagagtagcatctccccgtctcactctctcccttctcctgctttattttcttggtaaaatatcatttcagagcacgaggctttctttaagcaaaggacagacattttgcttattgctcaactagtttttgagctcatcctgaaaaaagtagcttttttgtctttcacttattaattcagtcaaaaaataatattactgtctagcaggctgggcgtggtggctcatgcctgtaatcccagcactttgggagaccaaggtgggcagactccctgaggtcagcagttcgagaccagcttggccaacatgatgaaaccgcgtctctactaaaaatacaaaaattagccaggcatggtagaatgtgcctgtaatcccagctacttaggaggctgcaacaggagaatcacttgaacctgggaggcagaggttgcagtgaaccaagatcgcaccattgtactccagcctgggcaaaagagtgagactccatctcatatatacttgagatgtatatatatgtatatatgtatacttttatatatatgtatacgtgtatatatgtatgtgtatacatgtatacatgtatgtgtatacgtgtatacatgtatgtgtatgcatgtatacatgcatgtgtatgcatgtatacatgcatgtgtatgcatgtatacatgcatgtgtatgcatgtatacatgtatgtgtatgcatgtatacatgtatgtgtatgcatgtatacatgcgtgtatgcatgtatacatgcgtgtatgcatgtatacatgcgtgtatgcatgtatacatgtgtgtatgcatgtatacatgtgtgtatgcatgtatgcatgtgtgtatgcatgtatgcatgtgtgtgtatgcatgtatgcatgtgtgtgtatgcatgtatgcatgtatgtgtgtgcatgtatacatgtatgtgtatgcatgtatgcatgtatgtgtatgcatgtatgcatgtatgtgtatgcatgtatgcatgtatgtgtgtgcatgtatacatgtatgtgtatgcatgtatataggtgtacatgtgtatgcatgtatataggtgtatatgtgtatgcatgtatatatgtgtgtatatgtgtacatgtatatatgtatgtgtacatgtatatatgtatgtatgtatacattatgtatacatatctgtcaagcataatgtcagaattagcaatattgattaaattatgtagtccttgaaggtagaaactctttttcactattgaatcctcaccacctggcatacaatagatactcaataattccttgtgtgggtgataaatgaatgggattccataacaaagttgatctgtgtaagacttttatttcactctttctataaaattaagtccacaatttttccatggatccttgcccaagaccacatgttgaaaagaacttatacgaatggcagatagcatcacggctaaagaaatagaatcttttgaagacaataactattttacttttaaaattgctcacaaattaaagaatgctggtagagataacaaagatgatttccaggagtaagaggccatcatgcagtttgtgatttccagatacttttgcagaaaggcaaccatgctgtagagtcagtagcagagttttcaccacctgtctaagacagaggaaaatgaccccaaaaaaaaaaggcaacttcaggcccttcttcaaaaatgcaaatccagggctacttccagctgtctccatagcatggcaaaacaatattcccagccaagcttcaagccattaagaaaaaccatcacagctgtgcgcggtggctcacgcctgtagtcccaacactttgggaggcccaggaaggcggatcacgaggtgaagagattgagaccactctggccaacatggtgaagccctgtctctactaaaaatacaaaaattagctgggcgcggtggtgcatgcctgtagtcccagctactcaggaggctgaggcaggagaatcgattgaacctgggaagcagagattgcagtgagccaagatgaagccactgcactccagcctggtgacagaacaagactctgtctcaaaaaaaaaataaaagaaaagaaaaaccatcacatatgtttggcaggggccaacatatccatggggttcagtaggcccacagtacttccagggacccacaaaagtgttctaataacatttaaaatcagaagaaaaaaatgaactgttaagtcaaaggaaaaatgttctaatatataatatgttaatacataatatcattatattcatctttataccaacacagtcctaaaatattacttttgatttttttttaatggaggaagaaaaccttgaaagcaaaagtgcctagggcctgtgaaagtcatcacatgaccctgatttggcgtctgctttgccttaaaaaagcattctagacagatattcagctggaaatactgaaatgggctcatgccaaaagaactagatctcttgttatccagaaaaccatattttctaggcagattcatttcccccaagatgcctaagagtcatgataacatattttagaggcgagattaatgcgatcgccccataaaatattttaagctctcatctgttctgaaacaaagtacgcaacatgtcaccaagagaaaatgactgctcataccgagaaaatgtattttcttcgaggtgccacagccactgtaatttgcacctcctgaagtgtagatggaagtcccctcaacatgtacagacagttaaaagagtcacggtaatgataggactagagaatgtgcccagctgagaaaataagcacacagcgagcattgtcagagctgaaaattaagatcccccaagcaaacatttcagatagagcccctcatcttttgttaaaagtaaaatgaaaatcaacagccctctacaccacatctgagccatggaagtcactccctttaggtgtctaagagacgactgcagcttcagtgcctggctcagattagctttgttcttccttgtctcttatcctttgaatagctctgacagtgccacaaggagtaattaccaattcgcagggggacacatcttcagttaaagtggattatctgcaagttgaggggtgggggttgctggcggctacaactgagttaggtattaagtataatctgcaaatgcagggagagttctgcagagccccaggcagttcttaactttctagaagtagctcccagctgaggcctcccctggtctccaggcatctggataatgtcttaactggtagagtgatggttaagagcatgagttttgggggcaaatttcctggttttatgcactggcacttcctagctcatgtgattctgggcaagttacttcactacagtgagcgacaatcagaatgggtccaaaattgtaccagccatagcaaggtgctgcagatgtagcaggacgaattgcagacaaaactcagacaccaagttaaagaaggaagaggtttattcagccgggagcatcggcaagactcctgtctcaagagccaagctacccgagtgagcaattcctgtcccttttaagggctcacaactctaagggggttccgtgtgagagggtcgtgatctattgagcaagcagggggtatgtgacaggggctgcatgcaccggtggtcagactgagacagaacagaccaggaagtttcacagtgtctttctatacaatgtctggagtctatagataacatcagttgctaggtcaggggtcgaattttaactaccaggcttaggtcaggcgggcccaggcctggtttcgggtctggttcctaggcactgggctacctgcctttagtttcgcttctctttccttttctgattatagaacaatataaaacaatatgagagggtctgtctctcttctctcacaaacattaataagacattgtgtttcaaatgctaagcatacatctaatacatggtaataaccccaagaatctttagctgttaccattatatttttatattttttttaattaaaattgaatcccttttttttttttttttttttttttttttttgtcttttgtgacagagtgcctctattgcccaggctggaacgcagtgctgtgatcttggctcactgcaacctccgcctcccaggttcaagccattctcatgccccaacctcccaagtagctggaattacaggggtgtgccactacacctggctaatttgtgccactacacccggctaatttgtgccactacacctggctaatttttgcattgttagtagagacagggtttcgccatgttggccaggatggtctcgaactcctggcctcaagtgatccaaagtgctgggattaccaacataagacatggcacccagcctctgttatcattattaagcattcatttaagccaagatctaaggggaaccaaggcccagtagcaaatctgctaatactcaggaaatgggtttgtgagaaatgttgctgttctttatcattattattattattattattattattattattattactattactgctacattcactatgagaaaacattcacgtctcagaaataacagtaataaggggtaagcattgccaggaggaggcagaaggcacatactggccaagtccggctctacgccctgtgtgtacagatatgtcttccaactttcgaaaagtctttgtaaaggttttcgctgatttgagctgttttcagctaagtcaccagaacatccagaatctaattttaaatgaaggttattataatgtccctcagtttcgtagcctcttattcaagagagattagaattctgtgaaggaaaagctttgttttaagttccaagggatgtaaagatttgctaggctgtctttaaatcccatttgggaactcaccatttatataaaaatggatgacatataatgtgtctttgggaacagtgaactctgaagagaaagatatggtcaaatggcccggcctcctcccacctcggaggatacactgcaccctcttcctacccctgatttggccctttcacaaatctcagctctagactgaggcagaaggacataaagatgcccatttccaaagctctccggctccccagtgcctctggttctatccatctttgtgacctgacgtctcagtggctgggtcccagatagggagctctggtctccggttcctggaggctgagcctgaatccctccacgcagaaagagagtcagggacagcaccgggggctgaatccctgccccaccttctagcagagtgacctcagtcaggtgactttactcctcaggctgtttcttttctggataacaaaaggtcattcaaccccatcttgtggattttctgtggagatttagttagataaaggactggcacacagggtgaagtgaggcagccttcccctcttccgcacagtgccacacagaacaggggtctgaggacttgccttctcccctgcatggctggtccccccctacccctgcccttccctggtgtttccaccgcaccccaccagctggaatgacatccaggattgaactcaatagccccttggcttacagggccactttctccacacctaccctggcagacttgatctcatatttgctttcagtataagatccagttgagcatccttccattaatgccccacagaacaagtctcagccttctccctggtgccggcctttccaacacctgaaggcagtgacggtgtgcttctagagtcttctcttccccacattcagcatccacagttccttccagtctgcttcacatgacaccgtctcaagcatggtgccatcctcaaaacacaccccggtttattattgctttcctgctcaagatgctctgtccagaactgatcacctctctggggtatgctgaccaccccaggggatggtctcagaaaccactttctaaattggaatatagactccatccttttcatgactcagtcaggtctcactcttaattcctaaatcccaaataattaacaaaaataccagagtcctgaggggttgctggaaaacaaaactggaaaaaaaaatccagttttcttctatcagccccattgtcccaacaaaggagggggagaggaggctacgtgcagttaccaggtgtgtcctatacaatttggtattgaaggtgattggggtgggggaaggcacgatggcatttccaaatatagaaattggttattcgtttctgctaaactgtatttagttatatctagggaaatcatttcagcctctcggagtccctttggctcacgataatgtcctcttgagtggagccatccctttttactaaatgccatatggcacattcatcaatgtgccattgatgtctttatccaagttaataaaatgattaaatgtaggcttggaatcaccactaaaattctccttgaagccaatttctacctatttatcaaattccaccactgttcatctcatgattaatctacctttaaaatactctcatgcatcactgaacgacagggatacgttctgagaagagtgtcattaagcaatttcatcattatgcgaataccacagagtgcacttacacaaacccagaaggtgcagccttctacacacccaggctctgtgctacagcccattgctcccaggctgcagacatgtgcagcacgccactgcactcaatactgtaggcaacggtaacacaacggtatttgttcactaaacatagacaaagtatggtaaaaatatgatataaaagataaaaattggctgggcgtggtggctcatgcctgtaatcccggcactttgggaggccgaggcaggcggatcacaaggtcaggagatcgagaccagcctggccagcatggtgaaaccccgtctctagtaaaaatacaaaaaaaattagctgggtgtggtggtgtgtgcctgtagtcccagctactcgggaggctgaggcaggagcatcgcgtgaacctgggagttggaggttgcagtgagtcaatatcacaccactgcactccagcctggggacagaacaagactccgtctcaaaaaaaataaataaaaaataaaagtaaaaattggtacccctatataggacacctaacaggaatgaagcttggcaggactggaagttgctctggatgagtgagtgggtggtaagtgaatatgaaggcctaggacattatactactgtagattttataagcactggacactttggccacattaaatttaccttttacaattttctttctttaataataaattaaccagctgggtgcagtggttcatgtctgtaatcccagcactttgggaggcagaggagggtagaccacttgaggtcaggagttaaaaaccagcctgatcaacatggtgaaaccccgtctctactaaaaatacaaaaattagcctggtgtggtggcatatgcctgtaatcccagctactcgggaggctgaggcaggagaattgcttgaacccaggaggcagaggttaccgtgagccgagattgtgccactgcatgcactccatcctggtcagcagaggaagactccatctcaaaataaataaataaataaaataaattaaccttagcatactgtaccttttctaactttatagacttcttaatgttttcaaactttttcactttttcatatttttgtctaacacttagattaaaacacaaacacattatacagctgtaaaaaatatttctttttatatgcgtattctataagattttgctatttaaaaatttgtttttaacttttaagacttttttattgaaaactaggacacaaatgcacacatttgctttggcctccacagggtgaggatcatcaataccactgtcttccacctgcacaccttgtcacactgggaggtcttcaggggcagtgacacacatggagctgtcatctcctgtgataacaatgccttcttctggaatagctcctgaaggacctgcctgaggctgttgtacaattaccctttttaaaaataaaaaataaaaaaaaagtaggccaggtgcagtggctcacacctgtaatcccaggactttgggaggctgaggcaagcagatcatgaggtcaggagttcgagaccagcctggccaacgtggtgaaaccccgtctctactaaaaatacaaaaattagccaggtgtggtggcgggtgcctataatcccagctacttgggaggctgaggcacaagaatcgcttgaacccagtaggtggaagttgtggtagctcagattgtgccactgcactccagcctggacgacagagcgagactcagtctcaaaaaacaacaacaacaaaaaagaagtatactctaaaataatgataaaaagcacattatgataaatgccaggcaatagaaaaatttcagctccattataatctcctgggaccaccctcctacatgtggttcatccttgaccaaagcatcattatgtggtgcctgactgtactactcaaacatattacaatgagaccatatctatttgtcttgaccacaaaaatgtcatgagaaacttactaaaatgctttgctgaaatttagatggcctctctcagtgctctcccacctaggaggctattaccccaatctgaaaataaaggaactggctttaggggttcagcagtgagaataggtgttgacaggaagaagtatccaaaggcctcccagtgggtctccggactgtgtcccttggtggcatccagggtggttgcgatcgtatggtttaaattttgtgatgatccactggagcttcaagttcagcctcaaagcattaggctctgttttctgaacatcattttatatggcaaggtcccgagattctaattttttcttgtgttaattatgtgacatggagcgtcagttaagggaaccatccaatacactttccagaaacagttctccctctcagtttcttcgtgtgcttgactggctcatggccctggggaaaccatcgctttcaatccctacctcaggtccatttcgtgatgtttatgcattcatgcgatcttagtcctcaaaggatttttttttcttctcttgggtaagatagctttagaggccttctgggataggaattataatacaactgagaacaaaggaagaaaaataaaaagtgaactactttctgttttactgaatcattcaacttgacattatctggaaatacaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagcttctggctgctcagtggacgcttctgccaatgctcacagccccacaggcctgggcccgggagcctctgctgccacccgtggtttctctccctgttccaccatcggaaccccgtgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgtattttctgttaacacaaggttcctttaaagtcaagtatgcagccctaaatcttatcgacccattaatatttcatccaaaacaatgtaacatcttaaactgaaacctaaatgtaagctttggacacaagcattcaaagacaggtatgttgtacagctggactatggtgagtcaagtaacattttcatttctttttttcttttagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcaggtaaagtcttcagcaacctcaggcaggttgcttcatttctttaaacctcagtctcttgggactatggaatggatttaataacagaacctcactggtaatgtcattggaggattaagaaagggcaaaggaacgttgtgagtacggagttctcagggcagcacttagcacatctgaaatactcagggccagaaataaataagttgaaggtaaagaatgtaggaagtattaactcttcaattaggttaaatgatgacttgcctaaactgatgtctgcgccatgactgtgggtgatttgatcaattcactgtctcacttttgcctcttatgactcttaatgacttgctgtaacataatctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccagcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgctataatgcttgaaccttgagtaaagacttccaaatcctctccccctgcaaacttgtaatttgtaacagttcattctctaaacctcgtgcatttgattgctttaatcatgttccggccctgcacatggagtgtgtggcttcagtgcagccattgtcattgtgattccttgccagggctgtgctgcaaagctttgtgaagcttagagagaagccaaaattgccctgttgtcagaataacccatttacagacgaaacaatcctctttgttcctcacacatggattcctagaacttgacgcggggcgctgtgagctaagggcacgtatgaagaattcccttttatgaatgttgttaagattacacagtgggctggcttgaacaaaggaaagcattcctaatgctgaaagaagaaaagtaagagtgaaaatacaagaggagaaaagacatgtcagggccacagaggaacagagatctctcagataaattcctccaaatgcccgagtagacaaataccgtgaatgatctttgcaaggcaggagtccttccgctgtcaaagggacccactgcctgaggctgtgagcacctgtggtctgagtcagggccaatagactagtttctaaaacatctagatcctaccttgggccaatatgagttttatgtattattacttaattaggaacttgtttgttaagatctgtgagatatgactgtagggaccaaagagtttttgttcctttactttaaaaaaatcatgctttgagtgtgacaggttttttttttttttttttttttttggagacagacagagtctcactcagttgcccatgctggagtacaatggcaccattgcaacctctgcctcctgggtttaagcgattctcctgcctcagcctcctgagtagctgggattacaggcacccgccatcatgcccacttaatttttgtagagacaggatttcaccatgttggccaaactggtcttggactcctaacctcaggtgatccacccgcctaggcctcccaaagtgctaggattacagagtgctaggattacaggattcttttgattgatttatgaaaatgtatatagggaacatatctgtatttgatgttcaaatccaaattctgtaattctgatattatggtaggcctgtgctatgtaacatgagatccatttgcagaaaaatttccacttacacttggagagttcttacccagtgtccagcagatgaagtattaatgcaattgtcattataccaattacaaggacagaaaacagttgaccgggctcggtggctcacatctgtaatcccagcattttgggaggctgaggtgggtggatcatgaggtcaggagttcgagaccagcctgaccaacacggtgaaagcccgtctctactaaaaatacaaaaattagctgggcgtggtggcgcacgcctgtaatcccagctcctcaggaggctgaggcaggagaatcgcttgaacttgggaggcagaggttgcactgagctgagatggtgccactgcaagactctgtctcaaaacaaaacaaaaaaacaacagaaaacagtttacaaactataaggcagaggtttattgaaataatatgattttcctcttttaggtgaataggaacatgagagacaatgtgggttgaggggctggaaggggcagaggacagacgtagaaatgagggaaggttacttaacagcagcctctggttgctcagtgtcagggaggaaaaacttttcctctgtcctcttaagttcagtacctgggggcctgcaaattaagctgataaaagacagattaacaggtgggcagggggaccttatttatatgcatataggagcttgaaaaagaagaaactcagtaagtagttaaagctagaaacttatatgcccagcttagtagggaaaagaggcagtgggggaaaaggcctctataggaggaacagatggatttctagaagaacaaatgagagataaagagtttgtgatagtgcttgttcatgcaggcctgagtgatctctgtatctcattcatggccataaaacttccctggagagaggacttacggtaggtttcttgatcatcttcctgggagtaaaagccacccgtaagagggaggtatggcagcctcatttttccagaagtctctgctttttgtcagataaaggaagcaccaagaaggcttctttctgcacctattgaatccccagtggcttcagtttaaaatgagttccataccaactcgggttctaagtgcatccctcacatcagcaattgcactctggtttcgtgagcctaaggtcatcattctgaatttggactttacggttttgcacttttctggtaatatttcatgtttgactagaataagattccttgctatcagatatttaaaaacaaaacagtatatacacaaaaatgcctttctacctgtaaataacgtgaggtacttgagtctgtgtagggttaggatggaaagaaaataacatgagagctcgtgagtcctggcttgactagaggacatttggaagtagattatctcatctggtgccttggaagtttattcctcaacaagcagcaatgggtctcctggaagcttttttagaaatgcagaatctcaggcccctccccatactgactaaatcagcattcgtgttttttagcatggttcccaggtgacttaccactgcaatttaaaagctctaatcttgtatagtgcttctcaatctgggaagcactttaaaactacctggggagctttttaaaacccaaaactacctggggagctttttaaaaccctgatgtcaagactatacttctgtcagaggtgtctgaaccagagcaactccatctcgaataggggctgggtaaaataaagctgagacctactgaaaactggttgcagtaaagaagccagctaaaaccatcaaaaccaagatggcaatgagattgacttctggtcatcctcactgctacactcccatcagcaccatgacagcttataaatgccatagcaatgtcaggaagttaccctatagggcctaaaaaaaggggaggcatgaatgatccaccccttgtttagcatataatcaagaaataaccataaaaatgggcaaccagcagcccttggggctgctctgtctgtggtgtagctattcttttattcctttttgttttattattatactttaagttttagggtacatgtgcacattgtgcaggttagttacatatgtatacatgtgccatgctggtacgctgcacccactaactcatcatctagcattaggtatatctcccagtgctatccctcccccctccccccaccccacaatagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctagaaaggacatgaactcatcattttttatggctgcacagtagtccatggtgtatatgtgccacattttcttaatccagtctatcattgttggacatttgggttggttccaagtctttgcaattgtgaatagtggaggaggagaggtgctctgctttttagagtttccagtttttctgctctgttttttccctatctttgtggttttatctacttttggtctttgatgatggtgatgtacagatgggtttttggtgtggttgtcctttctgtttgttagttttccttctaacagacaggaccctcagctgcaggtctgttggagtttgctagaggtccactccagaccctgtttgcctgggtatctgcagcggtgtttgcagaacagcggtttttcgtgaactgcgaatgctgccatctgatcgttcctctggaagttttgtctcagaggagtacccggccatgtgaagtgtcagtctgcccctactggggggtgcctcccagttaggctgctcaggggtcaggggtcagagacccacttgaggaggcagtctgcccattctcagatctccagctgcgtgctgggagaaccactgctcttttcaaagctcagatggaaatgcagaaatcacccatcttctgcgtcgctcatgctgggagctgtagactggagctgttcctattcagccatcttggctcctcctattcttttattcctttactttcccaattgatacagtttgactatgtccccacccaaatctcatcttgaattcccatgtgttgtgggagggacctggtgggaggtaattgaatcatgggggcaggtctttccatgctgttgtcgtgacagtgaataagtctcacaagatctgatggttttataaaggggagtttccctgcacaagctctctctttgcctgctgccatccatgtaagacatgacttgctcctccttgccttccaccatgattgtgaggcctcgccagccgtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtcttcatggttattttttaaaaagaaaaatcccaatatctagtactaaacccctgacggaccaaatcagaccctcggggggataggagggacacaggtgtgtgtgatgtaaacccccctccccaggagtgtccagtgtgtgaccaaggtcaagaatcactcaccaaatgaaagaagggtccctttggtaagtgcatcaaaataaggttaccaaaagaaaaaactgaatacccaaatactgcccaaaacatggtttatgaaaaacaataaagccgttaggtggttaaatcacaaatagtaaaggctgtaccatcaagcttgcaaagagaccaggctctccggccattttataaggaagctcactcagaggagatgtttttacctaaacttgaggagaactgatctgcctgtttgcaactggaaagcagacttgaaacaaacaaatgaacaataaatttgcagtgtggggcaggactcggtggctccagtgaaagcacctcattatgaggaagatgtgaaattattactgtgttttgaattggctgctaacctactctgaaagatagaaaaagatgctgctttaaaatgagggctgtgcttttctgaaaatacagcaggtgccttgctgtgaagagtaaggaatcatatggccttatggttaaagggatcttggcaaaccagggctactcaatccatacctataccaggatgtttgcatacctataccaggatgtttgttttgcaggaacttggtgttagaatggaaattagaattgaagacatctacccataggtctggtgatctttctgctcccatacctgtctttctactgtctgagatcatagtaaatgataaaaacagaaaataggttctaaggtatgctggctttagtaataagattctttttctcatctgtaacactactgttacacttctataacaaacactatttgttacctctccaatgtcctttgggctctatcagtgttttctaaaatgagggacatttatgttggtcaggttgtgcactgcacaactataacagatgtcatttgtagtgcagtctctggcttctggagcagtgcagcatgtagcctagatagggggtcgccattatgggaagcaaatagacatggcctcgtgtaacatacaaagcaagtcatttcctgttcatttgtctttcagtccttctgattttataaagagaaagtctctatttggttctggcacgcttttaacacctctcccatgattgtattttaccttataataaagagagaacaggcttctggttagtgcctcacaggcaatagaattactcagtagggatgtaaagttttatcaatagatttatataaataagaaatttaaccaattttgtgaaaataagtaaataaataatacttggattttacagtatatgtcaagaaaaatatgaaggtgattttcacatgattggagtttgggaaacactgggcagtagagaaagatcaccccaagcgctagggcctagcatggggctttaagaacacatttttatagggggatgaggtaaacaaaagacttacacattatgatttaagttgacttgatttaaaacaattctgctctattggaaacatccaatctttttttcttctagttatttccctctttgataataagtacagcctgtttctaaaccattatatggtccttaggaatatttttagaacagtagttacaaggtagaaaaagtaacccccagccctgagttaaggtttattttaaggtcacagaatgccaggcaattgccgtgatttacctctcagaattatggactctgttgtgtttcttcctttttgtctaatttagggaatcttatttgcttggaatgaaaaggatttgccagcaggaagacagccacagatggcagtgcacattctgtaaaatacaaaaacaaaacaaacaccagaaaaaataaatccaagagtctgatcccataaatttctgcactaaggagcaactccaaactgcacaccaagctgctttaaaaggcgtttgtgttaagccttagagtgttttatcacattcgtgatatttgatacagaatacgtcagaccaaaagccacatcctaggatcttctttaaaatatcattaaaatagatgaagcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattctactgcctcggcctcctgagtagctgggactacaggcacgcaccaccacacccagctaatttttgtgtttttagtagagacggggtttcaccatgttggccaggatggtctcgatctcttgacctcgtgatccgcccgcctcagcctcccaaagtgctgggattacaggcatgagccactgcgcctggccacagctagttattttaaaggacttctagtaggtccaggctagattctcagcaaagtttgcatggtatgtgatgtgtggtgcatctcaccccagaaaggacctgggagtccttctgtaaattgctagcaggtgaattcacagcatccactgtaaccttaagttatctggttctctgccctaacgctaacctgcatctgacactgggaggtccttgaccaggaattctcacagctcctccaacagggaagtgggtaggagatggaaaattcagaagcaggagtggagggaagggagttaacacccaattctccacctcccccagaaccaaggccaggattgtcaagaatccagggttgagaatcccctgccaagctggtccagtggattcactcaggttggcagagtggctgaaaaccagccctcttaggcacgtgggtcttctcccagatatattaggaactagatggaacttggcacttgggatcactcagtgtaacaaccccatacccccattagacttgagtatacccagcactgagctaggaactcactcaggcttcccgtcaccacatcggacactttaccactggccacagattggtttctgaagacctcttacctccatcgttatgacttctaagttgatttctgtctatattccaagtttcctttctatcatctggccataaaatatttttatatcttcatgtgcaaagagttatggatataaagaactttttaaaattacatatatcatctattctgttttctacctaactacaagctgatcattggttttctttaccacctgcaagcacttaaaagtaatcattcctgctcttataattacatctgaattatttctgaacagatcccttttctctccttatgctaagactgcatgattaatgcatttttatctctcacactcagtctttttattatgttatttgtctttttccctcttcagtcaccaacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtcttacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatgagttgggttaagtatctttgcatatgtttatatatcatttatatttatttttccataaactccctctttatattctttgctccaataattatttatatctttatattctttcctattgatttataagtattcttaatatattaagtaaattagtatttttaatgttttccttgtttcatctcaatttttttgaatttatgggatttttttttccatgtaaaagttactaaattttacatggtgaaatgtaaagtgttttatggcttttgggttttgtgacataccttctccatttagaacttattttttaaattattccatgttttttataataattttgtgttttatttgtaagttctacgtattttcttccctggaaatttatttgggtggaaggtggaaggtaaaaatctcactttattttttcccaaatggcccactgttccagccccattggttgaggctccatcctctccacctttaccatcttctaaattcccttcatttctgagtccctactggactctctggtctattacattgatatgatgccttgtgacatgggagcaaactgcagtacttatcattgagcttttattatcacatttagtggctcatagagctaatttccctttttttctgagttttttttcccagaattttcctgttcatccttgcacatttgcttttcccatgtggatttgagaattttaatcattttattggaattgtttaaaatttttactgggattaaggtttatgtataagttcattacctggtgatgcccagttacaccatgcgtgtcttctccatctctctccaagttgcgaaatgattcagataagtgtcatccagattttaatgtgcttagaatcacctgggggaaattagcaaatgcagattcagctggtcaaacatgggattagagattctgcatttccaacaagctcccaggtgctgctgatgcagcgggtccctggaacacactgggagtggcaaggagataagcagccttgaggcactgcctctggtagatttcataggtttcccctggaaaaccacttgagcccactgcttcttgtgggagcagatctttgacaactctctcaagttattttatgataatctgtctaattagattttctttctcatctaggataatacccgttattttatctttttctagaaattcgtgcatttaacctaggttttcaaactcattactgtggagttgaacagaaacttgttaataatttaatttccattccctttttcgtgttttttatattgaatgtttctgttgaccccccccccttattgattagattatgtggctttttttttttcttttctcaaagaaccagctcttagatttatttgtcaattctttgttttctttctactgtcgtgtcttctttaaatttatatttgctggcctctaactttctaatttgaatgtttggctctctctcttattttccttcttggtggggtgtgtgtatcatggtcttataagaatgtgaaccgaagtcaacaaatcttaaactccagccatgctctcttctgaccacacctctgctgccccagccccgcctccaggactgcaccctccagatgtaattgacaccaatggcttgcactagactttttgctaagggacctgaaaagaacttagaggctggcgtaagttgccaaagccttcccacatcactgagagaatagacttggcaggcttgtgttttgaaaagcagttgggggtgcgctctgtcaaggctcagccatgatgaagaaataatcaaagagcaaaacgtcacttaagtggctaaacatgactggcagcagggttggattccccttcagcatcgaacacctcacaggccatcctctgtgtagacgggctgctttctagtggctccacaggcctggccgtgtcaggggctgcctttattcaaagacttctgttctgtcttaaccaggatcacttaactctctgaaactccagtgataaaaaagcaaaaccggcacaaacatacagctttggaactatctccaaggtcattgttttttcccctgccgcgaatttctttcattcctaattttcctctacctttctttcccttcatcccctacgatagattttgaaccccagggaggttaggactctgtcccgttcttctccctgggctgtccaccctccgacccccaccccacctggcatggcactcaaaggtgcattttcctggggtctgtgcatggaaatcattgcagctgtcagcctgtgtcacgtggggctggctaagtgcggggcaacgcggttgtacatgttgccatggtgacttctctgttgatggcagaaccactgactccagcaagtcacagtattcatttttgcgtcatgctcgtgctacaggaatgctatgagtagcccatgaaaagggaggcgagttgagctcagtgttatcccttgacttgtgtgtctttccttacccccagcgatcccccattcagatgcttcctactgtaccgcatttttgagtattcttcagtatcatgcttctgttacagcaccatatcactcagctatggaagcactcagaggagcacaacaccctctaaattatccgccatcacttcttttacggcctcatttaaaaagacaattgtcagaattcccaggtgtgaattctcacaggggaatctctgtcagtcaccacctggaaatgttagttccacctctgctggccaatcagcacctcatgtccttgctatgatctctacagttgcagaagcattatcctgatgaggtttttaacacatcaccacatgcttttcagagaaaagtccttttataaataccaataactaaacatgataaattgcttcactcctttgagatctttgtctgattccacgtgctctgcatagactattcagaaattctaaagacggatgcagattcctaattctgctgttgagtttgttcctgagagcaacgctgaaagacttttaaaaaattaaaatcagctttatgttgaaatgtaattgtacataaatagccatatgaatgtggggtacagttattttaaacatagaaaataagatgaattgttttggaaattcccctttaaacatgctaaaatgattttcaatcattgacgggaattttaacttttagaaaactggaaaggatacagacaaaagtagtgataacttaaatttgtaaactattttatttgttgaaatgctttaatgcatgattttgttttatcctggaatggccacatgtggtaggcaaagtggacattatcagccacattttaaagataaggaaaatgcagctcagagaaaataaatgtattcattccctcagcaaacactgactgggtggccacagaagtgcggtgcacaaccctggctgcacatcagtcacctggggagcttttcacaaatcccaatgcctgttccccatcccagaggattcctggtgtgcatcaggattgtgaagcaatggggactgagtttatagcaccttactctaaagtatgcagagactagcattatgaagtggaaaatgcatatatttcagattcagttatttttttcccactattccttcctctcaatgaaaattttggagtaaaacatataattccagttctttattctgaactgtcttactattttctatcaccctttaaatataatgcagaagtctggaaggatatgtaatttgcatacctgttggtgaaatccctgctactaaatacactttgctttttcttgttccacattccccttttcgacagggaataaatcatccccaaggctgctagagccaattaaatattttttcacactccgttgacatgaatgagaagaactgtgacagagccacacggctcatgccaggactttatcacgctatctttataatgatgtgagccaggcaccagggaggaatggtgtggggaaccatcaggaagctttaataaccaaggataatttgtttcatcagtttctccttgatggccatttgccatttcacctgtcaggaagcaaaactagttgtcttgtgagatctcaggttaactcaagaagagaacagctcagacaacaatggaagcatatttagcatggagcttttatactcagttctctgaagtcagccttcttggaagaaaatacattgtcttgggattggaattataaatttcccttgtgctaatgcaaccgaaaagagtatttcaaaaccaagagccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctattggcagaactggtccacagagcacagaagcacattcatcgtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcctaagtattctcacaaatgatgaagcgcatctcttgagtagacttaaggtgataaaatgttattttcactgagctcccaagccatacatcatggaagtccaaagcccttactgataattgcataatgcccaggggatgtgtttctctgcagaagtctgaagacaatagatccagggtctcctgaagactttcatcttatgaattgtgcgaatccctgaccactgcctaagaggaaaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcctccctgataaacttgctttagagattcaacttgtatttttgctttgaaccaggaaaggtatccaaggtcatactaagataaccatttattaaactctttggctgttttttcctaaactgtaataaactccccctctccaacattcaaaataatagtaaataattctctctgaaattaacacagtgttcctattattgctttcacaacactaaaaagaaatagaactaacggagtcgaactgtggggcattctggcaggcaaatcattaaattcacacaaatgattcggccaagggaaaaaggacaaggttctcagaaggaattatttcagctccctctcagacactgctttaaattaaaacacacacacacacgagcagctgaagacctgagtcaccaatggtctacattaaatttctgcaactgaaagtcaggcaggtattcaagcactctgggagcctgttagaaatacagatgcccaggtcccccacccgagaccaactcaggcagaagcagcatttttaccaaagctcagggcatccgtatgccccttaatgtttgaaaggtctgaatcagagtgctctcccccaaaggcatctcagactgagatagaaattgaagaaaaagcctaaggaggttcagcaactttttcaaggccgaagaacccaccagttacacaagtgcagagccctttgtccctgacattcagagccctgcatgcataggaagtgacagccccttccggggcaccctgctgccgccacgcgcattctggaaactgtgcagcaggagaaacagcgttttccttcagaccggggtttaaatggcacttcccgaatttatattcccctagatttggggcttcttccttcttgcactcctgttaacatcagcatgaattcataaactccctgcagcggaaaggaaaagaagccgcgacaaacctcaacgaagagccgtacggcactgttaaccaagtgctccagtcctgccccagtgtttacaggaaattggttccaggacccccaaagacacccaaatccacagatcctcaagtttctgatagcaaatagtgtggtaaatacctacatataacctacacacaccctcccatatactttaaattgtctcttgtagattacttgtaatacctaatacaacataaatgctatgtaaagagttgttggccaggcacagtggctcacgcctgtaatccaagcactttgggaggctgaggcaagcagatcacgaggtcaggagttcgagaccagcctaaccaacatggtgaaacccaatctctactaaaaatacaaaaattagccgggcatggtggcgcatgcctgtaatttcagctactcaggaggctgaggcaggagaatcacttgaacccaggaagcagaggttgcagtgagctgagattgtgccactacactccagcctgggcgacagagtgagactccgcctcaaaaaaaaaaaaaagatttgttatgctggattgtttagggaacaatgacaagaaaaaaatatctgtacgtgttcagtacagctgaaactttttttcccgaatatttttgatctgagtttggttgaatccacagttggggaacccgtggatgtggagggccagctggatagctgctcctggcagtgaggctctctgatccagactttcaaggttcaccctgagaactacagtaagatacatgagagagtcctgaatgaggagtcgaaagacctcgtcctcgtagcagcgactctggcacccaccaaccatgtggctttcacctaattatcatccattctgcatttttgcctccttaactgtagagaggttgtggaactacagaatctataaaggccagctgtcacaatcaatactttacaagtgcccacaatattttacaataactttgaccattgatttataaacaattataaccaaacattaggactggaacaatttgcccacctgagaaataacaagacatttatctcacatgaaaatggacaccaaataccttaccttcgtgtttattttatgaaatacaaaatctgagcatatattaataatgagctatttttttcttttttcttttttttttgagatggagtcttgctcttttgcccaggctggagtgcagtggcacaatctcggctcactgcaatctccgcttcccgggttcatgctattctcctgcctcagcctcccgagtagctaggactacaggcacccaccaccacacccagctacttttttgtatttttagtagagacggggtttcaccgtgttaaccaggatggtctcgatctcccgacctcatgatctgtctgcctcagcctcccaaagtgctaggattacaggcgtgagccactgtgcccggcctaatgagctattttcaattaaaatacctctttatcgttaatcagacaaaagagtacaatgtcagcctactctgagagcattaagaaatctttttcctgaaaggcaattgagacaattcagaagttaactaagtaactgatggaaagagggagtacaatggaatcaattgcccactcagtcctttcatataaaagttggtttaaacaatcataacatatagccgatgacgacaaatttgtttattctgtttctcttcactcgacctcttttggtcactggatcttggacaatcatgaaagcagctgccactttctcattcctttaagaagctggaaatgtaaagcttgtttaacttttcaagtcaggagccaaaaagtcacaatcaccttcccctgtttgaaattggaaatgctggctggctactttttttttagaaactaggaagtgaagggtagagagagaaatgtgaaactcaggatcatgtcagtacatgccacataatgctctgcctacggaaaaacctgctgacttagagaaatcgctccctcccaaaaatgtgattagcagggatcctctcttaaaataaaacaatgtcccttatatcttcagcatcttagtcgataaccatttgttttcatatctgtttcagaaatatcaatagtgaatggctaaaaacattatttaagaaaaacaatcattttctgctatataactcagatttgaaaacagaataaaatgtaataaaacaaagaagctaagaacaaaggcagagatacctcatctcgcccggacccactgtaaaaataatgttgcaatttaaattaaattataattaatagcagcagttttgttgaagtgtctcaaattattactttagatgctgaaactccagtggtttccatggagatattttctctaggagatgtcagatatgatctaatttttttgtctctgatatatgacaacctgaagcttccagagcctttcattttggggggttttatgttagatatttcaatttatttttatatgcacttcaatatgttttgtttgcaattggtttctgagcctaaatattttgaaacttagtaaataagaaccacaaccaccaaatttatcttctgtagttaaaaaaaaaaaaaaactttactctctccttattcactaggacagacaaacatacttctccttgggtgaggagcatagtagtgcatatgtgtgtgggcgctaaagccttagccaggatgtttactaagtacgttcctgggagaagactctcccatcatcaattcctccagcaatatgtcctgcctggcctgtgcttggtggaggaggggaggagagctaatctctgagtggtgcaatggaaacatggtctacaaatataggaacacggatgactacacacaagggcacgtgcaagggaaatatgcagaaatatgtgggcttttataagactctaaatcagactggaatggcaccatgctttggtggttaacatggagtgtcatttggggatccgcaagagaagtatgttgaatagagtctgtgcttatttgatgaaagactggtcttgagaatgttatagctagtctgttttaaattaacacgccaaatttggacctactcactgtttcccaaagtataggttccttgatactccaacaccactaaaattgttcagctctcccagcaagctgggtgaggggaacgtggatgttagcagtagaataggtgagctttattatccatgtctcagtcatgtttcttggtctccgtttttctctgtgcgcatttccaagaggatgtttgttcccaggggaaaggtcagtggcaataaaatgtatctatcaaaatagcaattgtgttgatcgccagaataaaatggctttgcctcaagggggtaagcactcacatgcattaggacaaccaggcttacagcataaataaatccaggaaaataggagtgctcacactaaacaaacaaaagattttgcccttgaaatgtataaggattcctgacctgaggattttctacaagttattttctaacaataaccaaagtccagcggactaggagtcactaatatattttctatattcaatatgtccatctcctttgttaggaagaataagaaacctgcctcactgtaaggatttagttgagactaggcatctgactttcaaaattctacctgcatagaaggttttgttatcagaagaagctaccgatgtttacatacctcttaatcaactgattttaattatgccagccaatgaacatccatttagcccttgctactgcattgttagtcactggaactgcaaacatgattaagattggtctctgacttgaagaggatgactgtcatgtaagaagtcacaagaattaagattattcccattgagaaaagggacacacagtctgaggtcgctgaggatactttcaggaaagtggtaagatctgatggacaaagaaaaggatagtaaaccagatgtccagacagagtgccatatggcagagaaaaggtgtgtcaactggaggcatcaggaactcctatgagacgggagagttccctagaccccttcactggacttgcaacagggtacagctcactcaaaccttttgcgggacggcgagcacacaggcaagtgggtgccaccgctggggtgaacgcttttggtctccagccccacagcagcatctaggggtatgttacaattaatgctgttttaacagttactgtctggggatggctaagtgttaaccagctcattggagacagggtgacagacttttaccccctgccctcttggtacccaggtccttgtctggcatccaggaagaatcaggtcacacagttttattgagtgatggaggtggctctcagtgggatggggagctggaaagggatgaaatgggaagataattctcttcagtcatcctcagcgaaactgctttccaactgtccagttacctcttcaacattcagatgctgcttctcctcttgatgttcagccgcttgttctcttctctcctctgccacactgctctgctcctctgccagtggagcttggggtttttatggttacaggactggggggcatggcaggccaggctggttttggaaaaagcagcatttgggtgggaaaacagggctgtgaatttctcatttagggctgtgggctcaggtttgtgtgtggaacccttgccagggactccaccctcttctacccagtatttccctgcctcctgtccatatcacctatacctagaatgttgagttggaaaagtgaccccaggaaggaaggggcaggagagaaatccagctcaagggagtctttcttccctatgccaaggagttcagatttacacccaaaacaatcgtggaatatttttaaatgttcctccctagctcttgtcattctccttgcgtcatctcaggtaactccttccactatctccgtatgttctgctactgtttttatccgtaacctcaagggaaccagattaccattgtaattttttttttttttttttttttttttgagacggagtctcgctctgtcgccagggtggagtgcagtggtgcaatctcggctcgctacaacctccgcctcccaggttcaagcggttcaagcaattctcctgcttcagcctcctgagtagctgggactacaggcacgtgccaccatgcacagctaatttttttttttttttttttttttttttttttttgagacagtctcgctctgtcaccaggctggagtgcagtggcacgatctcagctcactgcaacctctgcctcccaggttcaagtgattctcctgcctcagcctcccgagtagctgggactacaggcgcacgccatcatgcccagctaatttttgtatttttagtagagacggggtttcaccatgttggccaggatggtctcgatctcttgacctcatgatccacttgccttggactcaccgtgcctggcctaccattgtaattttttatcactatatttaatatatttcgaaggtacatattatttaaagaaggtcggccgggcgcggtggctcacgcctgtaatcccagcactttaagaggccaagaccggcagatcacgaggtcaggagatcgagaccatcttggataacacggtgaaaccccgtttctactaaaaatacaaaaaattagccgggcatgttggcgggcgcctgtagtcccagctactcgggaggctgaggcaggagaatggcgtgaacccaggaggcagagcttgcagtgagctgagatcgcgccactgcactccaacctgggggacacagcgagactccatctcaaaaaataaagaaagaaagaaggtcatgacggggcaggggataagggaagacaaagaaaaaggaggtcaggaaatttctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttaactagactattcacaagcttggtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataactgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcatggtggcaggtgcctgtaatcccagctacttgggaggctgaggcaggagaaacacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaattatttgggatcaatagtatacttgactctgacacttgactctttctttctctacagccagtgcggattttccatataatccaggacaaggccaagctataagaaatggagtcaacagaaactcggctatcattggaggtaggtgatgtctagaggaggcttatatggggctactcaactatggaaagtaatagttgtcaataacatagtagtctaggaaaaaaagttttctaggtttttacattattcattttgctgtttaaagattatgacatatgatgtgaagaaatatagtaaatatagccgggcacagtggctcacctctgttatcctagcactttgggaggccgaggtgggcagatcacctgaggtcaggaattcgagaccagcctagccaacatggcaaaaccccatatctactaaaaatacaaaaattagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcaggaggctgaggcaggagaatggcgtgaacctgggaggcggagcttgcagtgagccaagattgtgccactgcaatccggcctgggctaaagagcgggactccgtctcaaaaaaaaaaaaaaaaaagaaagaaagaaagaatatagtaaatgtaacctggctactttttaatgctggcttgtaaaaaacaaatagcagtggaaagctggacagactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgcattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccattaagatcccaatcctcactgtcttttgcttttttaaatgaacttaattgaagtataatacgcatctataagtgtaacaagtccgtaacttttatttattattattttttgagacagagtctcactttctgttgcccaggctggagtgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaatatatatatatatatatatatatatatatatatatatatatatattgctccatagttttcttgtaacatttttctggttttagtgtcaggataatgctggtctcataaaatgaattgagtagtgttttctcctcctatattttaagaaagatgtgtaggattggtctaatatcattaggtaatgcttgttagtagtattgttcgagtcttttaaatttttgctgattttctgttcaattgttctatcagttactgacagaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaacgtagctattccagcttatgattattgtttgcatatcttttcccacccttttactgttgacctgtatttaaagttcatgtcttgtagatatcatatagtaggcatcttttttatccactgtctctactttttaattggagtgtttagatcagttatatttacttctgttttatctaatctgtattatttcatccagtatttttttctttttccattttttttttttagacagagtcccccccccccccctcacacaagctggagtgcagtggcacgatcttggctcactgcagcctccgcctcccaggttcaagcgattctcacgcctcagcatcttggctagctgggatcacaggagcgtgccaccatgcctggctgatttttgtacttttagtataaaagaccgggtttcaccatgttgcccaggctggtcttaaactcctgacctcaagtaatccgcccgcctcagcctcccaaagtgctgggattacaggcgcgagccactgctcatttcagacattgtgtgtttcacctctacaagttccacgttgtctcattttttttcccctcattttgatcatgttttcctttaaacccctgtgcaggtttctaatagctattgtactgtcctcatctgctcattccatgctctgtcctttctgtttctaatagctattgtactgtcctcatctgctcattccatgctctgtcctttctggctctccttctaattgactgatgtttcttctggtcaagtgacattttgctacattttttttctctgaattatttttctctgcagcttgacgttatttagatgtgttttaaagctttttcaggacagagctagagtagtctttattctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccattcagggaaaccactgtgctttcttgtgctgcccctccctacactgctgtccaaaaatcgctgccagccagaaaactaggaaaaatgtaggattcctcctttttgtttctctgttctcagacatcatggttcctttctgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctgtgtctgacggagctgtagtgaagtggggacagtgttggagggactcccaagccctgtctaacctctcgtgcttctcctttctccgtcaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaa
